US012698490B2

(12) United States Patent
Barrangou et al.

(10) Patent No.: US 12,698,490 B2
(45) Date of Patent: Aug. 4, 2026

(54) METHODS AND COMPOSITIONS FOR SEQUENCES GUIDING Cas9 TARGETING

(71) Applicant: NORTH CAROLINA STATE UNIVERSITY, Raleigh, NC (US)

(72) Inventors: Rodolphe Barrangou, Raleigh, NC (US); Kurt M. Selle, Raleigh, NC (US); Alexandra Briner Crawley, Cary, NC (US)

(73) Assignee: NORTH CAROLINA STATE UNIVERSITY, Raleigh, NC (US)

( * ) Notice: Subject to any disclaimer, the term of this patent is extended or adjusted under 35 U.S.C. 154(b) by 1190 days.

(21) Appl. No.: 17/002,133

(22) Filed: Aug. 25, 2020

(65) Prior Publication Data

US 2021/0017507 A1     Jan. 21, 2021

Related U.S. Application Data

(62) Division of application No. 15/113,656, filed as application No. PCT/US2015/012747 on Jan. 23, 2015, now Pat. No. 10,787,654.

(60) Provisional application No. 61/986,427, filed on Apr. 30, 2014, provisional application No. 61/931,515, filed on Jan. 24, 2014.

(51) Int. Cl.
*C12N 9/22* (2006.01)
*C12N 15/85* (2006.01)

(52) U.S. Cl.
CPC .............. *C12N 9/22* (2013.01); *C12N 15/85* (2013.01); *C12Y 301/00* (2013.01)

(58) Field of Classification Search
CPC ......... C12N 9/22; C12N 15/85; C12Y 301/00
See application file for complete search history.

(56) References Cited

U.S. PATENT DOCUMENTS

| | | | |
|---|---|---|---|
| 7,919,277 B2 | 4/2011 | Russell et al. | |
| 8,361,725 B2 | 1/2013 | Russell et al. | |
| 8,697,359 B1 | 4/2014 | Zhang | |
| 8,993,233 B2 | 3/2015 | Zhang et al. | |
| 9,023,649 B2 | 5/2015 | Mali et al. | |
| 9,260,723 B2 | 2/2016 | Mali et al. | |
| 9,701,964 B2 | 7/2017 | Clube et al. | |
| 9,951,341 B2 | 4/2018 | Horvath et al. | |
| 9,951,342 B2 | 4/2018 | Barrangou et al. | |
| 10,136,649 B2 | 11/2018 | Barrangou et al. | |
| 10,266,850 B2 * | 4/2019 | Doudna .................. | A61P 43/00 |
| 10,506,812 B2 | 12/2019 | Clube | |
| 10,767,156 B2 * | 9/2020 | Sorek .................. | C07K 14/195 |
| 10,787,654 B2 | 9/2020 | Barrangou et al. | |
| 11,155,823 B2 | 10/2021 | Beisel et al. | |
| 11,261,451 B2 | 3/2022 | Barrangou et al. | |
| 2006/0199190 A1 | 9/2006 | Russell et al. | |
| 2009/0007301 A1 | 1/2009 | Wintz et al. | |
| 2010/0093617 A1 | 4/2010 | Barrangou et al. | |

| | | | |
|---|---|---|---|
| 2011/0300541 A1 | 12/2011 | Russell et al. | |
| 2013/0158245 A1 | 6/2013 | Russell et al. | |
| 2013/0288251 A1 | 10/2013 | Horvath et al. | |
| 2014/0068797 A1 | 3/2014 | Doudna et al. | |
| 2014/0113376 A1 | 4/2014 | Sorek et al. | |
| 2014/0186919 A1 | 7/2014 | Zhang et al. | |
| 2014/0186958 A1 | 7/2014 | Zhang et al. | |
| 2014/0234972 A1 | 8/2014 | Zhang | |
| 2014/0273233 A1 | 9/2014 | Chen et al. | |
| 2014/0315985 A1 | 10/2014 | May et al. | |
| 2014/0356867 A1 | 12/2014 | Peter et al. | |
| 2014/0356956 A1 | 12/2014 | Church et al. | |
| 2015/0050699 A1 | 2/2015 | Siksnys et al. | |
| 2015/0056628 A1 | 2/2015 | Russell et al. | |
| 2015/0064138 A1 | 3/2015 | Lu et al. | |
| 2015/0093473 A1 | 4/2015 | Barrangou et al. | |
| 2015/0098954 A1 | 4/2015 | Hyde et al. | |
| 2015/0132263 A1 | 5/2015 | Liu et al. | |
| 2015/0291961 A1 | 10/2015 | Siksnys et al. | |
| 2015/0315576 A1 | 11/2015 | Caliando et al. | |
| 2015/0353901 A1 | 12/2015 | Liu et al. | |
| 2016/0017366 A1 * | 1/2016 | Chen ................... | C12N 15/907 |
| 2016/0024510 A1 | 1/2016 | Bikard et al. | |
| 2016/0186152 A1 | 6/2016 | Brouns et al. | |
| 2016/0186213 A1 | 6/2016 | Zhang et al. | |
| 2016/0289700 A1 | 10/2016 | Barrangou et al. | |
| 2016/0298096 A1 | 10/2016 | Charpentier et al. | |
| 2016/0324938 A1 | 11/2016 | Bikard | |
| 2016/0333348 A1 | 11/2016 | Clube et al. | |
| 2016/0345578 A1 | 12/2016 | Barrangou et al. | |
| 2017/0002339 A1 | 1/2017 | Barrangou et al. | |
| 2017/0028083 A1 | 2/2017 | Beisel et al. | |
| 2017/0073663 A1 | 3/2017 | Wang et al. | |
| 2017/0196225 A1 | 7/2017 | Clube et al. | |
| 2017/0246221 A1 | 8/2017 | Clube et al. | |

(Continued)

FOREIGN PATENT DOCUMENTS

| | | |
|---|---|---|
| DK | 3307872 T3 | 10/2023 |
| EP | 2860267 | 4/2015 |

(Continued)

OTHER PUBLICATIONS

Briner et al. (Molecular cell 56.2 (2014): 333-339 ) (Year: 2014).*
Briner 2014 supplementary materials (Year: 2014).*
Lecuit, et al., "Internalin of Listeria monocytogenes with an Intact Leucine-Rich Repeat Region Is Sufficient to Promote Internalization", Infection and Immunity. vol. 65, No. 12, pp. 5309-5319 (1997).
Wilson, et al., Principles and Techniques of Biochemistry and Molecular Biology. 7th ed. Cambridge University Press, pp. 214-218 (2010).
Chylinski Krzysztof et al., Supplemental Material to: "The tracrRNA and Cas9 families of type II CRISPR-Cas immunity systems", RNA biology, 10(5) 32 pages (2013).
Sakuma, et al., "Multiplex genome engineering in human cells using all-in-one CRISPR/Cas9 vector system", Scientific Reports. 4:5400, DOI: 10.1038/srep05400 (2014).

(Continued)

*Primary Examiner* — Sahana S Kaup

(74) *Attorney, Agent, or Firm* — Myers Bigel, P.A.

(57) ABSTRACT

The present invention is directed to methods and compositions for genome editing and DNA targeting of proteins.

21 Claims, 33 Drawing Sheets

Specification includes a Sequence Listing.

(56) References Cited

U.S. PATENT DOCUMENTS

| | | |
|---|---|---|
| 2017/0260546 A1 | 9/2017 | Qimron |
| 2017/0275648 A1 | 9/2017 | Barrangou et al. |
| 2018/0064114 A1 | 3/2018 | Clube |
| 2018/0064115 A1 | 3/2018 | Clube et al. |
| 2018/0070594 A1 | 3/2018 | Clube et al. |
| 2018/0084785 A1 | 3/2018 | Clube |
| 2018/0084786 A1 | 3/2018 | Clube |
| 2018/0146681 A1 | 5/2018 | Clube |
| 2018/0155729 A1 | 6/2018 | Beisel et al. |
| 2018/0200387 A1 | 7/2018 | Porteus |
| 2018/0258411 A1 | 9/2018 | Kadiyala et al. |
| 2018/0273937 A1 | 9/2018 | Beisel et al. |

FOREIGN PATENT DOCUMENTS

| | | |
|---|---|---|
| EP | 3307872 B1 | 9/2023 |
| WO | 0054154 A1 | 9/2000 |
| WO | 0176772 A2 | 10/2001 |
| WO | 2006/113709 | 10/2006 |
| WO | 2010/054154 | 1/2010 |
| WO | 2010/075424 | 7/2010 |
| WO | 2013/098244 | 7/2013 |
| WO | 2013/141680 | 9/2013 |
| WO | 2013/176772 | 11/2013 |
| WO | 2013/188522 | 12/2013 |
| WO | 2013/188638 | 12/2013 |
| WO | 2014/022702 | 2/2014 |
| WO | 2014/065596 | 5/2014 |
| WO | 2014/071235 | 5/2014 |
| WO | 2014/093479 | 6/2014 |
| WO | 2014093595 A9 | 6/2014 |
| WO | 2014/110006 | 7/2014 |
| WO | 2014/113493 | 7/2014 |
| WO | 2014/124226 | 8/2014 |
| WO | 2014/144155 | 9/2014 |
| WO | 2014/144592 | 9/2014 |
| WO | 2014/150624 | 9/2014 |
| WO | 2014/186686 | 11/2014 |
| WO | 2014/191128 | 12/2014 |
| WO | 2014/191518 | 12/2014 |
| WO | 2014/201015 | 12/2014 |
| WO | 2014/204727 | 12/2014 |
| WO | 2015/021353 | 2/2015 |
| WO | 2015/026886 | 2/2015 |
| WO | 2015/034872 | 3/2015 |
| WO | 2015/035139 | 3/2015 |
| WO | 2015/040402 | 3/2015 |
| WO | 2015/053995 | 4/2015 |
| WO | 2015/066119 | 5/2015 |
| WO | 2015/070193 | 5/2015 |
| WO | 2015/077290 | 5/2015 |
| WO | 2015/089277 | 6/2015 |
| WO | 2015/089406 | 6/2015 |
| WO | 2015/089486 | 6/2015 |
| WO | 2015/112896 | 7/2015 |
| WO | 2015/116686 | 8/2015 |
| WO | 2015/119941 | 8/2015 |
| WO | 2015/139139 | 9/2015 |
| WO | 2015/148680 | 10/2015 |
| WO | 2015/153791 | 10/2015 |
| WO | 2015/153889 | 10/2015 |
| WO | 2015/153940 | 10/2015 |
| WO | 2015/155686 | 10/2015 |
| WO | 2015/159068 | 10/2015 |
| WO | 2015/159086 | 10/2015 |
| WO | 2015/159087 | 10/2015 |
| WO | 2015/160683 | 10/2015 |
| WO | 2015/189693 | 12/2015 |
| WO | 2015/200555 | 12/2015 |
| WO | 2016033298 A1 | 3/2016 |
| WO | 2016/084088 | 6/2016 |
| WO | 2016/177682 | 11/2016 |
| WO | 2016/196361 | 12/2016 |
| WO | 2016/205276 | 12/2016 |
| WO | 2017/027423 | 2/2017 |
| WO | 2017/058751 | 4/2017 |
| WO | 2017/066497 | 4/2017 |
| WO | 2017/112620 | 6/2017 |
| WO | 2017/147507 | 8/2017 |
| WO | 2018217981 A1 | 11/2018 |

OTHER PUBLICATIONS

Chauthaiwale, V. M. et al. "Bacteriophage Lamda as a Cloning Vector" Microbiological Reviews, 56(4):577-591 (1992).

Dang, Y. et al. "Optimizing sgRNA structure to improve CRISPR-Cas9 knockout efficiency" Genome Biology, 16(280):1-10 (2015).

Edgar, R. et al. "Reversing Bacterial Resistance to Antibiotics by Phage-Mediated Delivery of Dominant Sensitive Genes" Applied and Environmental Microbiology, 78(3):744-751 (2011).

Extended European Search Report corresponding to European Patent Application No. 18806333.3 (8 pages) (dated Feb. 9, 2021).

Third Party Observation filed in European Patent Application No. 16804164.8 on Feb. 19, 2021, 15 pages.

Third Party Observation filed in European Patent Application No. 16812275.2 on Feb. 19, 2021, 38 pages.

Yosef, I. et al. "Temperate and lytic bacteriophages programmed to sensitize and kill antibiotic-resistant bacteria" PNAS, 112(23):7267-7272 (2015).

Gutierrez et al. "Predicting CRISPR-Cas9 activity in *E. coli*" bioRxviv, https://doi.org/10.1101/308148, pp. 1-22 2018.

Hochstrassera et al. "CasA mediates Cas3-catalyzed target degradation during CRISPR RNA-guided interference" PNAS, 111(18):6618-23 2014.

Nizet et al. "Bacterial sepsis and meningitis" Remington and Klein's Infectious diseases of the fetus and newborn infant, 8th Edition, pp. 217-271 2011.

Verco et al. "Cytotoxic Chromosomal Targeting by CRISPR/Cas Systems Can Reshape Bacterial Genomes and Expel or Remodel Pathogenicity Islands" PLOS Genetics, 9(4):1-13 2013.

Sashital et al. "Mechanism of foreign DNA selection in a bacterial adaptive immune system" Mol Cell., 46(5):6061-615 2012.

Third Party Observations corresponding to U.S. Appl. No. 15/735,028, dated Aug. 30, 2019 17 pages.

Edgar et al. Supplemental Material "The *Escherichia coli* CRISPR System Protects from Lysogenization, Lysogens, and Prophage Induction" Journal of Bacteriology, 192(23): 6292-6294 2010.

Shinkai "Structure and Function of CRISPR-Cas System" Seibutsu Butsuri, 54(5):247-252 (2014) Abstract Only.

Extended European Search Report regarding European Application No. EP19196063, dated Jun. 26, 2020 12 pages.

Third Party Observations corresponding to European Patent Application No. 16804164.8, dated Jul. 24, 2019 60 pages.

Third Party Observations corresponding to European Patent Application No. 16812275.2, dated May 15, 2020 108 pages.

Ajdic et al. "hypothetical protein SMU_1405c [*Streptococcus mutans* UA159]", Proc. Natl. Acad. Sci. U.S.A. 99 (22), 14434-14439 (2002) URL: https://www.ncbi.nlm.nih.gov/protein/NP_721764.1/, retrieved Jul. 20, 2018.

Anderson et al. "Lactobacillus gasseri CRISPR-Cas9 characterization In Vitro reveals a flexible mode of protospacer-adjacent motif recognition" PLOS ONE, 13(2) 14 pages, 2018.

Barrangou R. "CRISPR-Cas systems and RNA-guided interference", Wiley interdisciplinary reviews, RNA (2013) 4: pp. 267-278.

Barrangou R., et al. "CRISPR-Cas systems: prokaryotes upgrade to adaptive immunity", Mol Cell (2014) 54(2): pp. 234-244.

Barrangou R., et al. "CRISPR: new horizons in phage resistance and strain identification" Annu Rev Food Sci Technol (2012) 3, pp. 143-162.

Barrangou, R. "Diversity of CRISPR-Cas immune systems and molecular machines", Genome Biology (2015) 16:247, 11 pages.

Barrangou, R., et al. "CRISPR provides acquired resistance against viruses in prokaryotes", Science (2007) 315(5819): pp. 1709-1712.

Beisel CL et al. A CRISPR design for next-generation antimicrobials. Genome Biology. 2014; 15: 516, 4 pages.

(56)         References Cited

OTHER PUBLICATIONS

Beloglazova et al. "Structure and activity of the Cas3 HD nuclease MJ0384, an effector enzyme of the CRISPR interference" The EMBO Journal, 30:4616-4627 (2011).
Bhaya et al. "CRISPR-Cas Systems in Bacteria and Archaea: Versatile Small RNAs for Adaptive Defense and Regulation", Annu. Rev. Genet. (2011) 45: pp. 273-297.
Bikard D. et al. "Programmable repression and activation of bacterial gene expression using an engineered CRISPR-Cas system" Nucleic Acids Res (2013) 41(15): pp. 7429-7437.
Bikard D., et al. "CRISPR interference can prevent natural transformation and virulence acquisition during in vivo bacterial infection", Cell Host & Microbe (2012), 10 pages.
Bikard D., et al. "Exploiting CRISPR-Cas nucleases to produce sequence-specific antimicrobial", Nature Biotechnology 2014, 6 pages.
Boudry et al. "Function of CRISPR-Cas System of the Human Pathogen Clostridium difficile" mBio, 6(5):1-15 2015.
Briner AE, Barrangou R. "Lactobacillus buchneri Genotyping on the Basis of Clustered Regularly Interspaced Short Palindromic Repeat (CRISPR) Locus Diversity", Appl Environ Microbiol. 80:994-1001, (2014).
Briner et al. "Guide RNA Functional Modules Direct Cas9 Activity and Orthogonality", Molecular Cell. (2014) 56(2): pp. 333-339.
Brouns SJJ, et al. "Small CRISPR RNAs guide antiviral defense in prokaryotes", Science (2008) 321:5891, pp. 960-964.
Carte et al. "The three major types of CRISPR-Cas systems function independently in CRISPR RNA biogenesis in *Streptococcus thermophilus*", Molecular Microbiology, 93(1), pp. 98-112 (2014).
Chylinski et al. "Classification and evolution of type II CRISPR-Cas Systems", Nucleic Acids Research, (2014) 15 pages.
Chylinski Krzysztof et al., "The tracrRNA and Cas9 families of type II CRISPR-Cas immunity systems", RNA biology, 10:5, 13 pages (2013).
Citorik R., et al. "Sequence-specific antimicrobials using efficiently delivered RNA-guided nucleases", Nature Biotechnology 2014, 7 pages.
Claesson MJ et al. NCBI reference sequence NC_007929, direct submission Dec. 16, 2005, p. 1 (2005).
Cochrane Kyla et al., "Complete genome sequences and analysis of the *Fusobacterium nucleatum* subspecies *animalis* 7-1 bacteriophage PHIFunu1 and PHIFunu2", Anaerobe, 38:125-129 (2016).
Cong et al. "Multiplex Genome Engineering Using CRISPR/Cas Systems" Science (2013) vol. 339 (6121): pp. 819-823.
Cong et al. Supplementary Materials for "Multiplex Genome Engineering Using CRISPR/Cas Systems" Science (2013) vol. 339 (6121): pp. 819-823.
Crawley et al. "Characterizing the activity of abundant, diverse and active CRISPR-Cas systems in lactobacilli" Scientific Reports, 8:1-12(2018).
Darmon E, Leach DF "Bacterial Genome Instability", Microbiol. Mol. Biol. Rev. (2014) vol. 78, pp. 1-39.
Database GenBank [online]. NBI, U.S. National Library of Medicine. Aug. 5, 2014. "CRISPER-associated protein, Csn1 family [Bifidobacterium bombi DSM 19703]." XP002785852, retrieved from NCBI accession No. GenBank: KFF31259. Database accession No. KFF31259. 1 page.
Deltcheva, E. et al. "CRISPR RNA maturation by trans-encoded small RNA and host factor RNase III", Nature, vol. 471, (Mar. 2011) pp. 602-607.
Doench et al. "Rational design of highly active sgRNAs for CRISPR-Cas9-medlated gene inactivation", Nature Biotechnology, 32:12 (2014) 8 pages.
Dupuis Mè et al., "CRISPR-Cas and restriction-modification systems are compatible and increase phage resistance", Nat Commun., vol. 4, p. 2087 (2013).
Edgar R., et al. "The *Escherichia coli* CRISPR System Protects from Lysogenization, Lysogens, and Prophage Induction", Journal of Bacteriology (2010), vol. 192, No. 23, pp. 6292-6294.
Estvelt et al. "Orthogonal Cas9 proteins for RNA-guided gene regulation and editing", Nature Methods, 10:11 (2013) pp. 1116-1121.
Final Office Action, U.S. Appl. No. 15/032,985, mailed Feb. 5, 2019, 31 pages.
Final Office Action, U.S. Appl. No. 15/113,656, mailed Jul. 30, 2018, 8 pages.
Final Office Action, U.S. Appl. No. 15/302,655, mailed Nov. 2, 2018, 21 pp.
Fonfara, I. et al. "Phylogeny of Cas9 determines functional exchangeability of dual-RNA and Cas9 among orthologous type II CRISPR-Cas systems", Nucleic Acids Res (2013) 14 pages.
Fu et al. "Improving CRISPR-Cas nuclease specificity using truncated guide RNAs", Nature Biotechnology, 32:3 (2013) 9 pages.
Garneau JE, et al. "The CRISPR/Cas bacterial immune system cleaves bacteriophage and plasmid DNA" Nature (2010) 468(7320): pp. 67-71.
Gasiunas et al. "Molecular mechanisms of CRISPR-mediated microbial immunity" Cellular and Molecular Life Sciences, 71:449-465 (2014).
Gasiunas et al. "Cas9-crRNA ribonucleoprotein complex mediates specific DNA cleavage for adaptive immunity in bacteria", Proc. Natl. Acad. Sci. (2012), 109:E2579-E2586.
GenBank Accession No. FN692037.1, "Lactobacillus crispatus ST1 complete genome, strain ST1" Feb. 27, 2015.
Gilbert et al. "Genome-Scale CRISPR-Mediated Control of Gene Repression and Activation", Cell, 159 (2014) pp. 647-661.
Gilbert, L. A. et al. "CRISPR-Mediated Modular RNA-Guided Regulation of Transcription in Eukaryotes", Cell 154, (2013) pp. 442-451.
Gomaa AA, et al. "Programmable Removal of Bacterial Strains by Use of Genome-Targeting CRISPR-Cas Systems", mBio (2014), 5(1):e00928-13.
Grissa et al. "The CRISPRdb database and tools to display CRISPRs and to generate dictionaries of spacers and repeats" BMC Bioinformatics, 8(172):1-10 (2007).
Haurwitz et al. "Sequence- and Structure-Specific RNA Processing by a CRISPR Endonuclease", Science (2010) 329: pp. 1355-1358.
Heinl, Stefan et al. "Insights into the completely annotated genome of Lactobacillus buchneri CD034, a strain isolated from stable grass silage", Journal of Biotechnology, 161:153-166 (2012).
Hidalgo-Cantabrana et al. "Genome editing using the endogenous type I CRISPR-Cas system in Lactobacillus crispatus" PNAS, 116)32):15774-15783 (2019).
Horvath and Barrangou "CRISPR/Cas, the Immune System of Bacteria and Archaea", Science (2010) 327, pp. 167-170.
Horvath, P. et al. "Diversity, Activity, and Evolution of CRISPR Loci in *Streptococcus thermophilus*", J Bacteriol. 190 (2008) pp. 1401-1412.
Hsu et al. "DNA targeting specificity of RNA-guided Cas9 nucleases", Nature Biotechnology, 31:9 (2013) pp. 827-834.
International Preliminary Report on Patentability Notification, PCT/US2018/034322, mailed Dec. 5, 2019, 7 pages.
International Search Report and Written Opinion corresponding to PCT/US2019/52861, malled Feb. 12, 2020, 18 pages.
International Search Report and Written Opinion corresponding to PCT/US2019/52864, mailed Dec. 17, 2019, 15 pages.
International Search Report and Written Opinion corresponding to PCT/US2019/52878, mailed Dec. 27, 2019, 14 pages.
International Search Report and Written Opinion corresponding to PCT/US2019/52883, mailed Dec. 23, 2019, 9 pages.
International Search Report and Written Opinion for PCT/US2015/047136 mailed Nov. 26, 2015, 10 pages.
International Search Report and Written Opinion, PCT/US2018/034322, mailed Sep. 13, 2018, 7 pages.
Jiang, W. et al. "Dealing with the Evolutionary Downside of CRISPR Immunity: Bacteria and Beneficial Plasmids", PLOS Genetics (2013) vol. 9, issue 9, 13 pages.
Jiang, W. et al. "RNA-guided editing of bacterial genomes using CRISPR-Cas systems", Nat. Biotechnol. (2013) vol. 31, pp. 233-239.

US 12,698,490 B2

Page 4

(56) References Cited

OTHER PUBLICATIONS

Jinek et al. "A Programmable Dual-RNA-Guided DNA Endonuclease in Adaptive Bacterial Immunity", Science (2012) vol. 337, pp. 816-821.

Jinek, M. et al., "Structures of Cas9 endonucleases reveal RNA-mediated conformational activation", Science (2014) vol. 343, 6176, 28 pages.

Karvelis, Tautvydas et al., "crRNA and tracerRNK guide Cas9-mediated DNA interference in *Streptococcus thermophilus*," RNA Biology, 2013, vol. 10, Issue 5, pp. 841-851.

Karvelis, Tautvydas et al., "Programmable DNA cleavage in vitro by Cas9," Biochem. Soc. Trans. 2013, vol. 41, part 6, pp. 1401-1406.

Kobayashi K, et al. "Essential Bacillus subtilis genes", Proc. Natl. Acad. Sci. U.S.A. (2003) vol. 100, pp. 4678-4683.

Labrie SJ et al. "Bacteriophage resistance mechanisms" Nat. Rev. Microbiol (2010) vol. 8, pp. 317-327.

Liu S et al. Complete genome sequence of Lactobacillus buchneri NRRL B-30929, a novel strain from a commercial ethanol plant. Journal of Bacteriology. Aug. 2011; 193(15): 4019-4020.

Liu S et al. NCBI (2011) CRISPR-associated protein, Csn1 family [Lactobacillus buchneri], pp. 1-3.

Luo, M. et al., "Repurposing endogenous type I CRISPR-Cas systems for programmable gene repression", Nucleic Acid Research (2014) 8 pages.

Magadan et al. "Cleavage of Phage DNA by the *Streptococcus thermophilus* CRISPR3-Cas System", PLoS One (2012) 7:e40913. 8 pages.

Mahillon J. et al. "Insertion sequences", Microbiol Mol Biol Rev (1998) vol. 62(3): pp. 725-774.

Makarova and Koonin "Annotation and Classification of CRISPR-Cas Systems", Methods Mol Biol. (2015), 1311: pp. 47-75.

Makarova et al. "An updated evolutionary classification of CRISPR-Cas systems", Nat Rev Microbiol. 13:722-736 (2015), 15 pages.

Makarova et al. "Unification of Cas protein families and a simple scenario for the origin and evolution of CRISPRCas systems", Biol Direct. (2011) vol. 6:38, 27 pages.

Makarova, K. S. et al. "Evolution and classification of the CRISPR-Cas systems", Nat Rev Microbiol (2011) vol. 9, pp. 467-477.

Marcotte, H. et al. "Proteomes—Lactobacillus gasseri DSM 14869", NCBI Reference Sequence CP006803, (2013) URL: https://www.uniprot.org/proteomes/UP000217220, retrieved Jul. 20, 2018.

Marraffini and Sontheimer "CRISPR Interference Limits Horizontal Gene Transfer in Staphylococci by Targeting DNA", Science (2008) vol. 322: pp. 1843-1845.

Milani C et al. Genomic encyclopedia of type strains of the genus *Bifidobacterium*. Applied and Environmental Microbiology. Oct. 2014; 80(20): 6290-6302.

Mojica, F. et al. "Short motif sequences determine the targets of the prokaryotic CRISPR defence system", Microbiology (2009) vol. 155, 8 pages.

Nale Janet Y. et al., "Diverse temperate bacteriophage carriage in Clostridium difficile 027 strains", PLoS One, 7(5) 1-9 (2012).

Nishimasu, H., et al. "Crystal Structure of Cas9 in Complex with Guide RNA and Target DNA", Cell (2014) vol. 156, pp. 935-949.

Notification and Transmittal of International Search Report and Written Opinion of the International Searching Authority for International Application No. PCT/IB2015/052515; Date of Mailing: Oct. 10, 2015; 12 pages.

Notification of International Preliminary Report on Patentability corresponding to international Application No. PCT/IB2015/052515; Dated Oct. 12, 2016, 7 pages.

Notification of Transmittal of the International Search Report and the Written Opinion of the International Searching Authority, or the Declaration, PCT/US2016/034812, Sep. 15, 2016, 9 pages.

Novagen "pCDF-1b Vector" Sep. 10, 2003, Retrieved from the Internet on Sep. 1, 2015, at http://www.helmholtz-muenchen.de/fieadmin/PEPF/pCDF_vectors/pCDF-1b_map.pdf, 2 pages.

Oh JH and van Pijkeren JP "CRISPR-Cas9-assisted recombineering in Lactobacillus reuteri", Nucleic Acids Res (2014) vol. 10.1093/nar/gku623.

Ojala et al. "Comparative genomics of Lactobacillus crispatus suggests novel mechanisms for the competitive exclusion of Garnerella vaginalis" BNC Genomics, 15:1070 (2014).

Qi, L. S. et al. "Repurposing CRISPR as an RNA-Guided Platform for Sequence-Specific Control of Gene Expression", Cell 152, 1173-1183 (2013), 11 pages.

Ramakrishna Suresh et al. "Gene disruption by cell-penetrating peptide-mediated delivery of Cas9 protein and guide RNA", Genome Research, 24:1020-1027 (2014).

Rath et al. "The CRISPR-Cas immune system: Biology, mechanisms and applications" Biochimie, 117:119-128 (2015).

Sander JD, and Joung JK. "CRISPR-Cas systems for editing, regulating and targeting genomes", Nat. Biotechnol. (2014) vol. 32, pp. 347-355.

Sanozky-Dawes et al. "Occurrence and activity of a type II CRUSPR-Cas system in Lactobacillus gasseri" Microbiology, 161:1752-1761 2015.

Sapranauskas et al. "The *Streptococcus thermophilus* CRISPR/Cas system provides immunity in *Escherichia coli*", Nucleic Acid Res. (2011) vol. 39: pp. 9275-9282.

Seed Kimberley D. et al., "A bacteriophage encodes its own CRISPR/Cas adaptive response to evade host innate immunity", Nature, 494:7438, pp. 489-491 (2013).

Selle K, Barrangou R. "Harnessing CRISPR-Cas systems for bacterial genome editing", Cell Press: Trends Microbiol. (2015) vol. 23(4): pp. 225-232.

Selle, K. et al. "CRISPR-based screening of genomic island excision events in bacteria", Proc Natl Acad Sci USA, (2015); 112(26): pp. 8076-8081.

Selle, K. et al., "CRISPR-Based Technologies and the Future of Food Science", Journal of Food Science (2015) vol. 80, 6 pages.

Semenova et al. "Interference by clustered regularly interspaced short palindromic repeat (CRISPR) RNA is governed by a seed sequence", PNAS, 108:25 (2011) 6 pages.

Sinkuna, T. et al. "In vitro reconstitution of Cascade-mediated CRISPR immunity in *Streptococcus thermophilus*", The EMBO Journal (2013) vol. 32, pp. 385-394.

Spath et al. "Lactobacillus plantarum and Lactobacillus buchneri as Expression Systems: Evaluation of Different Origins of Replication for the Design of Suitable Shuttle Vectors" Mol. Biotechnol., 52:40-48 (2012).

Stern, A. et al., "Self-targeting by CRISPR: gene regulation or autoimmunity", Cell Press: Trends in Genetics, (2010) vol. 26, No. 8, 6 pages.

Sternberg et al. "DNA interrogation by the CRISPR RNA-guided endonuclease Cas9", Nature, vol. 507, (2014) 17 pages.

Terns and Terns "CRISPR-based adaptive immune systems", Curr. Opin. Microbiol. (2011) vol. 14: pp. 321-327.

Uchiyama Jumpei et al., "Characterization of Helicobacter pylori bacteriophage KHP30", Applied and environmental microbiology, 79(10):3176-3184 (2013).

Vercoe RB, et al. "Cytotoxic chromosomal targeting by CRISPR/Cas systems can reshape bacterial genomes and expel or remodel pathogenicity islands", PLoS Genet (2013) vol. 9(4):e1003454.

Westra et al. "CRISPR Immunity Relies on the Consecutive Binding and Degradation of Negatively Supercoiled Invader DNA by Cascade and Cas3" Molecular Cell, 46:595-605 (2012).

Westra et al. "The CRISPRs, They Are A-Changin': How Prokaryotes Generate Adaptive Immunity", Annu. Rev. Genet. (2012) vol. 46: pp. 311-339.

Wiedenheft et al. "RNA-guided complex from a bacterial immune system enhances target recognition through seed sequence interactions", PNAS, 108:36 (2011) 7 pages.

Written Opinion and International Search Report corresponding to International Application No. PCT/US2016/037493, mailed Sep. 15, 2016, 8 pages.

Written Opinion of the International Search Report regarding International Application No. PCT/US2016/067657, dated Mar. 6, 2017, 9 pages.

(56) References Cited

OTHER PUBLICATIONS

Yosef et al. "High-temperature protein G is essential for activity of the *Escherichia coli* clustered regularly interspaced short palindromic repeats (CRISPR)/Cas system" Proc Natl Acad Sci, 108(50):20136-20141 (2011).

Luo et al. "The CRISPR RNA-guided surveillance complex in *Escherichia coli* accommodates extended RNA Spacers" Nucleic Acids Research, 44(15):7385-7394 2016.

Gagnon et al., "Efficient Mutagenesis by Cas9 Protein-Mediated Oligonucleotide Insertion and Large-Scale Assessment of Single-Guide RNAs", PLOS ONE. 9(5): e98186 (2014).

Australian Examination Report corresponding to Australian Application No. 2022204596 (4 pages) (dated Mar. 18, 2024).

Final Office Action, U.S. Appl. No. 15/507,176, mailed Jan. 16, 2019 (30 pages).

Final Office Action, U.S. Appl. No. 16/153,052, mailed Dec. 26, 2018 (14 pages).

International Preliminary Report on Patentability corresponding to International Application No. PCT/US2014/062801; Dated: May 3, 2016 (13 pages).

International Search Report corresponding to International Application No. PCT/US2014/062801, dated Feb. 18, 2015 (4 pages).

Office Action, U.S. Appl. No. 15/113,656, mailed Mar. 11, 2019 (22 pages).

Third Party Observation filed in European Application No. 16812275.2 on Aug. 31, 2018 (89 pages).

Arslan, Zihni , et al., "RcsB-BglJ-mediated activation of Cascade operon does not induce the maturation of CRISPR RNAs in *E. coli* K12", RNA Biology, 10(5), 2013, 708-715.

Briner , et al., "Supplemental Information to: "Guide RNA Functional Modules Direct Cas9 Activity and Orthogonality"", Molecular Cell, 56, 2014, 10 pages.

Crooks, Gavin E., et al., "WebLogo: A Sequence Logo Generator", Genome Research, 14(6), 2004, 1188-1190.

Deveau, Hélène , et al., "Phage Response to CRISPR-Encoded Resistance in *Streptococcus thermophilus*", Journal of Bacteriology, 190(4), 2008, 1390-1400.

Dimarzio, Michael , et al., "Antibiotic Resistance in *Salmonella enterica* Serovar Typhimurium Associates with CRISPR Sequence Type", Antimicrobial Agents and Chemotherapy, 57(9), 2013, 4282-4289.

Horvath, Philippe , et al., "CRISPR/Cas, the Immune System of Bacteria and Archaea", Science, 327(5962), 2010, 167-170.

Jackson, Ryan N., et al., "Crystal structure of the CRISPR RNA-guided surveillance complex from *Escherichia coli*", Science, 345(6203), 2014, 1473-1479.

Kesik-Szeloch, Agata , et al., "Characterising the biology of novel lytic bacteriophages infecting multidrug resistant Klebsiella pneumoniae", Virology Journal, 10(Article No. 100), 2013, 1-12.

Liu, Yefeng , et al., "Novel Virulence Gene and Clustered Regularly Interspaced Short Palindromic Repeat (CRISPR) Multilocus Sequence Typing Scheme for Subtyping of the Major Serovars of *Salmonella enterica* subsp. *enterica*", Applied and Environmental Microbiology, 77(6), 2011, 1946-1956.

Liu, Fenyun , et al., "Subtyping *Salmonella enterica* Serovar Enteritidis Isolates from Different Sources by Using Sequence Typing Based on Virulence Genes and Clustered Regularly Interspaced Short Palindromic Repeats (CRISPRs)", Applied and Environmental Microbiology, 77(13), 2011, 4520-4526.

Lovisolo, Osvaldo , et al., "Coevolution of viruses with hosts and vectors and possible paleontology", Advances in Virus Research, 62, 2003, 325-379.

Luo, Michelle L., et al., "Current and future prospects for CRISPR-based tools in bacteria", Biotechnology and Bioengineering, 113(5), 2016, 930-943.

Mali, Prashant , et al., "RNA-Guided Human Genome Engineering via Cas9", Science, 339(6121), 2013, 823-826.

Paez-Espino, David , et al., "Strong bias in the bacterial CRISPR elements that confer immunity to phage", Nature Communications, 4(Article No. 1430), 2013, 1-7.

Shariat, Nikki , et al., "Subtyping of *Salmonella enterica* Serovar Newport Outbreak Isolates by CRISPR-MVLST and Determination of the Relationship between CRISPR-MVLST and PFGE Results", Journal of Clinical Microbiology, 51(7), 2013, 2328-2336.

Shariat, Nikki , et al., "The combination of CRISPR-MVLST and PFGE provides increased discriminatory power for differentiating human clinical isolates of *Salmonella enterica* subsp. *enterica* serovar Enteritidis", Food Microbiology, 34 (1), 2013, 164-173.

Skennerton, Conner T., et al., "Phage Encoded H-NS: A Potential Achilles Heel in the Bacterial Defence System", PLoS ONE, 6(5), 2011, 1-7.

Takeda, Toshiharu , et al., "Distribution of genes encoding nucleoid-associated protein homologs in plasmids", International Journal of Evolutionary Biology, 2011(Article ID 6850151), 2011, 1-30.

Vega, Nicole M., et al., "Collective antibiotic resistance: mechanisms and implications", Current Opinion in Microbiology, 21, 2014, 28-34.

Ward , et al., "Lactobacillus jensenii 115-3-CHN, whole genome shotgun sequencing project", GenBank: ACQN00000000.1. Submitted (Aug. 4, 2009), 2009, 1-2.

Weinberger, Ariel , et al., "Persisting Viral Sequences Shape Microbial CRISPR-based Immunity", PLoS Computational Biology, 8(4): e1002475, 2012, 1-16.

Yin, Shuang , et al., "The Evolutionary Divergence of Shiga Toxin-Producing *Escherichia coli* Is Reflected in Clustered Regularly Interspaced Short Palindromic Repeat (CRISPR) Spacer Composition", Applied and Environmental Microbiology, 79(18), 2013, 5710-5720.

Shah, S.A. et al. "Protospacer recognition motifs: Mixed identities and functional diversity" RNA Biology, 10(5):891-899 (2013).

Wallace et al. "A CRISPR with Roles in Myxococcus xanthus Development and Exopolysaccharid Production" Journal of Bacteriology, 196(23):4036-4043 (2014).

Certified priority document U.S. Appl. No. 62/175,749, filed Jun. 15, 2025.

Corrected Grounds of Opposition corresponding to European Application No. 16812275.2; dated Jan. 4, 2024 (55 pages).

Declaration of Assistant Professor Nina Molin Hoyland-Kroghsbo, dated Jan. 26, 2023.

Declaration of Dr. Jakob Krause Haaber, dated Oct. 25, 2023.

Declaration of Professor Gautam Dantas, dated Feb. 3, 2021.

Declaration of Professor Jay Hinton, dated Jan. 23, 2023.

EPO's Investigation Division's letter of Apr. 30, 2021.

Locus Opposition to SNIPR Technology patent, EP Patent 3291679B1; dated Sep. 15, 2022.

North Carolina State University's letter submitted to the EPO on Apr. 29, 2019.

North Carolina State University's response to the EPO dated Aug. 27, 2021.

Notice of Opposition corresponding to DK/EP Patent 3307872; dated Oct. 26, 2023 (42 pages).

Notice of Opposition corresponding to European Application No. 16812275.2; dated Nov. 6, 2023 (61 pages).

SNIPR Technology's response to Locus further comments in opposition against EP3291679B1, dated Jul. 5, 2023.

SNIPR Technology's response to Locus opposition to EP 3291679B1, dated Jan. 21, 2023.

Transcript of Oct. 25, 2023 of the Wikipedia article for *Escherichia* virus T4.

US prosecution document U.S. Appl. No. 16/153,052 including Dr.Ousterout's statement, dated Jun. 19, 2020.

Agilent Technologies, Lambda Zap II Undigested Vector Kit, Instruction Manual, Catalog #236201, Revision B0 27, Oct. 2015.

"Conference information including Abstract entitled "Regulation of the CRISPR-Cas adaptive immune system by bacterial cell-cell communication" (p. 56 of book of Abstracts).", The conference was entitled "Regulating with RNA in Bacteria and Archaea Conference" Cancun, Mexico, 2015.

Aguilar, Claudio , et al., "Cell-Cell Communication in BioFilms of Gram-Negative Bacteria", Bacterial Signaling 2: 23-40, 2009.

Almeida, Alexandre , et al., "A unified catalog of 204,938 reference genomes from the human gut microbiome", Nature Biotechnology 39: 105-114, 2021.

(56) References Cited

OTHER PUBLICATIONS

Avlund, Mikkel , et al., "Why Do Phage Play Dice?", Journal of Virology 83(22): 11416-11420, 2009.

Dantas, Gautam , et al., "Context matters—the complex interplay between resistome genotypes and resistance phenotypes", Current Opinion in Microbiology 15: 577-582, 2012.

Dillon, Shane C., et al., "Genome-wide analysis of the H-NS and Sfh regulatory networks in Salmonella typhimurium identifies a plasmid-encoded transcription silencing mechanism", Molecular Microbiology 76(5): 1250-1265, 2010.

Dorman, Charles J., et al., "Nucleoid-Associated Proteins and Bacterial Physiology", Adv. Appl. Microbio. 67: 47-64, 2009.

Doyle, Marie , et al., "An H-NS-like Stealth Protein Aids Horizontal DNA Transmission in Bacteria", Science 12(315): 251-252, 2007.

Elias, Sivan , et al., "Multi-species biofilms: living with friendly neighbors", FEMS Microbiol Rev 36: 990-1004, 2012.

Faruque, Shah M., et al., "Self-limiting nature of seasonal cholera epidemics: Role of host-mediated amplification of phage", PNAS 102(17): 6119-6124, 2005.

Federle, Michael J., et al., "Interspecies communication in bacteria", J Clin Invest. 112(9):1291-1299, 2003.

Gao, Rong , et al., "Genome-Wide RNA Sequencing Analysis of Quorum Sensing-Controlled Regulons in the Plant-Associated Burkholderia glumae PG1 Strain", Applied and Environmental Microbiology 81(23): 7993-8007, 2015.

Hagen, Stephen J., et al., "The Physical Basis of Bacterial Quorum Communication—Chapter 1", Biological and Medical Physics, Biomedical Engineering, Springer, 2015.

Hoyland-Kroghsbo, Nina Molin, et al., "A Quorum-Sensing-Induced Bacteriophage Defense Mechanism", mBio 4(1): e00362-12, 2013.

Kalia, Vipin Chandra, "Quorum Sensing vs Quorum Quenching: A Battle with No End in Sight", Springer, 2015.

Kaminski, Michael M., et al., "CRISPR-based diagnostics", Nature Biomedica I Engineering 5: 643-656, 2021.

Khare, Anupama , et al., "Multifactorial Competition and Resistance in a Two-Species Bacterial System", PLoS Genet 11(12): e1005715, 2015.

Krom, Russell J., et al., "Engineered Phagemids for Nonlytic, Targeted Antibacterial Therapies", Nano Letters 15(7): 4808-4813, 2015.

Lucchini, Sacha, et al., "Sacha et al. H-NS Mediates the Silencing of Laterally Acquired Genes in Bacteria", PLoS Pathogens 2(8):746-752, 2006.

Meredith, Hannah R., et al., "Collective antibiotic tolerance: Mechanisms, dynamics, and intervention", Nat Chem Biol. 11(3): 182-188, 2015.

Michelsen, Charlotte Frydenlund, et al., "Staphylococcus aureus Alters Growth Activity, Autolysis, and Antibiotic Tolerance in a Human Host-Adapted Pseudomonas aeruginosa Lineage", Journal of Bacteriology 196(22): 3903-3911, 2014.

Mitri, Sara , et al., "The Genotypic View of Social Interactions in Microbial Communities", Annu. Rev. Genet. 47: 247-273, 2013.

Moons, Pieter , et al., "Bacterial interactions in biofilms", Critical Reviews in Microbiology 35(3): 157-168, 2009.

Park, Joo Youn , et al., "Genetic engineering of a temperate phage-based delivery system for CRISPR/Cas9 antimicrobials against Staphylococcus aureus", Scientific Reports 7:44929, 2017.

Pawluk, April , et al., "A New Group of Phage Anti-CRISPR Genes Inhibits the Type I-E CRISPR-Cas System of Pseudomonas aeruginosa", mBio 5(2): e00896-14, 2014.

Rajagopala, Seesandra V., et al., "The protein interaction map of bacteriophage lambda", BMC Microbiology 11:213, 2011.

Rinninella, Emanuele , et al., "What is the Healthy Gut Microbiota Composition? A Changing Ecosystem across Age, Environment, Diet, and Diseases", Microorganisms 7:14, 2019.

Rossello-Mora, Ramon , et al., "The species concept for prokaryotes", FEMS Microbiology Reviews 25: 39-67, 2001.

Rutherford, Steven T., et al., "Bacterial Quorum Sensing: Its Role in Virulence and Possibilities for Its Control", Cold Spring Harb Perspect Med 2: a012427, 2012.

Short, Jay M., et al., "Lambda ZAP: a bacteriophage lambda expression vector with in vivo excision properties", Nucleic Acids Research 16(15): 7583-7600, 1988.

Srivastava, Sheela , "Genetics of Bacteria", Springer, 2013.

Stecher, Barbel , et al., "Gut inflammation can boost horizontal gene transfer between pathogenic and commensal Enterobacteriaceae", PNAS Early Edition, 2012.

Tridgett, Matthew, et al., "Engineering Bacteria to Produce Pure Phage-like Particles for Gene Delivery", ACS Synth. Biol. 10: 107-114, 2021.

Westwater, Caroline , et al., "Development of a P1 phagemid system for the delivery of DNA into Gram-negative bacteria", Microbiology 148: 943-950, 2002.

Xavier, Karina B., et al., "Interference with AI-2-Mediated Bacterial Cell-Cell Communication", Nature 437(7059): 750-753, 2005.

Zeng, Lanying , et al., "Decision Making at a Subcellular Level Determines the Outcome of Bacteriophage Infection", Cell 141: 682-691, 2010.

Douillard, et al., "Comparative Genomic and Functional Analysis of 100 Lactobacillus rhamnosus Strains and Their Comparison with Strain GG", PLoS Genetics 9(8): e1003683, 2013 (15 pages).

Kankainen, et al., "Comparative genomic analysis of Lactobacillus rhamnosus GG reveals pili containing a human-mucus binding protein", PNAS 106(40): 17193-17198, 2009.

Heussler et al. "Clustered Regularly Interspaced Short Palindromic Repeat-Dependent, Biofilm-Specific Death of Pseudomonas aeruginosa Mediated by Increased Expression of Phage-Related Genes" mBio 6(3): e00129-15, 13 pages (2015).

Preliminary Opinion of the Opposition Division corresponding to European Application No. 16812275.2; dated Oct. 30, 2025 (22 pages).

* cited by examiner

Fig. 1

CLUSTAL 2.1 multiple sequence alignment

```
St_henryi_DSM_19005                    GATAAGGCTT  10
St_infantarius_subsp_infantari         GATAAGGCTT  10
St_orisratti_DSM_15617                 GATAAGGCTT  10
St_parasanguinis_F0449                 GATAAGGCTT  10
St_gordonii_str_Challis_substr         GATAAGGCTT  10
St_anginosus_1_2_62CV                  GATAAGGCTT  10
St_intermedius_B196                    GATAAGGCTT  10
St_mutans_NLML5                        GATAAGGCTT  10
St_vestibularis_ATCC_49124             GATAAGGCTT  10
St_thermophilus_CRISPR1                GATAAGGCTT  10
St_lutetiensis_033                     --TAAGGC--   6
St_gallolyticus_ATCC_BAA-2069          --TAAGGC--   6
St_intermedius_SK54                    --TAAGGC--   6
St_mutans_UA159                        --TAAGGC--   6
St_anginosis_DSM20563                  --TAAGGC--   6
St_equi_subsp_zooepidemicus            --TAAGGC--   6
St_dysagalactiae_subsp_equisim         --TAAGGC--   6
St_pyogenes_M1_GAS                     --TAAGGC--   6
St_agalactiae_GB00300                  --TAAGGC--   6
St_oralis_SK304                        --TAAGGC--   6
St_mitis_SK321                         --TAAGGC--   6
St_sanguinis_SK330                     --TAAGGC--   6
St_salivarius_K12                      --TAAGGC--   6
St_thermophilus_LMD-9_CRISPR3          --TAAGGC--   6
Lb_brevis_subsp_gravesensis_AT         --TCAAACAA   8
Lb_buchneri_ATCC_11577                 --TCAAACAA   8
Lb_casei                               --TCAAACAA   8
Lb_coryniformis_subsp_corynifo         --TCAAACAA   8
Lb_curvatus_CRL_705                    --TCAAACAA   8
Lb_mucosae_LM1_177_17                  --TCAAACAA   8
Lb_paracasei_subsp_Paracasei_8         --TCAAACAA   8
Lb_paracasei_subsp_Tolerans_Lp         --TCAAACAA   8
Lb_pentosus_IG1                        --TCAAACAA   8
Lb_pentosus_KCA1                       --TCAAACAA   8
Lb_plantarum_EGD-AQ4                   --TCAAACAA   8
Lb_reuteri_mlc3                        --TCAAACAA   8
Lb_rhamnosus_GG                        --TCAAACAA   8
Lb_salivarius_UCC118                   --TCAAACAA   8
Lb_sanfranciscensis_TMW_1.1304         --TCAAACAA   8
Lb_fermentum_28-3-CHN                  --TCAAACGA   8
Lb_buchneri_CD034                      --TCAAGCAA   8
Lb_crispatus_FB049-03                  --TCAAGCAA   8
Lb_delbrueckii_subsp_Lactis_CR         --TCAAGCAA   8
Lb_gasseri_K7                          --TCAAGCAA   8
Lb_hominis_CRBIP                       --TCAAGCAA   8
Lb_jensenii_115-3-CHN                  --TCAAGCAA   8
Lb_johnsonii_DPC_6026                  --TCAAGCAA   8
Lb_otakiensis_JCM_15040                --TCAAGCAA   8
Lb_rossiae_DSM_15814                   --TCAAGCAA   8
Lb_ruminis_ATCC_25644                  --TCAAGCAA   8
                                          *  *   *
```

St CRISPR 1 nexus

St CRISPR 3 nexus

Lrh nexus

Lbu nexus 0.5

Fig. 5

```
CLUSTAL 2.1 multiple sequence alignment

Lb_fermentum_28-3-CHN                    CAAGA-  5
         Lb_pentosus_KCA1                         CAAGA-  5
         Lb_plantarum_EGD-AQ4                     CAAGA-  5
         Lb_otakiensis_JCM_15040                  IAAAA-  5
         Lb_rossiae_DSM_15814                     TAAAA-  5
         Lb_johnsonii_DPC_6026                    TAAAA-  5
         Lb_jensenii_115-3-CHN                    TAAAA-  5
         Lb_hominis_CRBIP                         TAAAA-  5
         Lb_gasseri_K7                            TAAAA-  5
         Lb_delbrueckii_subsp_Lactis_CR           TAAAA-  5
         Lb_crispatus_FB049-03                    TAAAA-  5
         Lb_buchneri_CD034                        TAAAA-  5
         Lb_sanfranciscensis_TMW_1.1304           TAAAA-  5
         Lb_reuteri_mlc3                          TAAAA-  5
         Lb_curvatus_CRL_705                      TAAAA-  5
         Lb_coryniformis_subsp_coryniform         TAAAA-  5
         St_lutetiensis_033                       TAAAA-  5
         St_gallolyticus_ATCC_BAA-2069            TAAAA-  5
         St_intermedius_SK54                      TAAAA-  5
         St_mutans_UA159                          TAAAA-  5
         St_anginosis_DSM20563                    TAAAA-  5
         St_equi_subsp_zooepidemicus              TAAAA-  5
         St_dysagalactiae_subsp_equisim           TAAAA-  5
         St_pyogenes_M1_GAS                       TAAAA-  5
         St_agalactiae_GB00300                    TAAAA-  5
         St_oralis_SK304                          TAAAA-  5
         St_mitis_SK321                           TAAAA-  5
         St_sanguinis_SK330                       TAAAA-  5
         St_salivarius_K12                        TAAAA-  5
         St_thermophilus_LMD-9_CRISPR3            TAAAA-  5
         St_infantarius_subsp_infantari           TACAAA  6
         St_henryi_DSM_19005                      TACAAA  6
         St_orisratti_DSM_15617                   TACAAA  6
         St_parasanguinis_F0449                   TACAAA  6
         St_gordonii_str_Challis_substr           TACAAA  6
         St_anginosus_1_2_62CV                    TACAAA  6
         St_intermedius_B196                      TACAAA  6
         St_mutans_NLML5                          TACAAA  6
         St_vestibularis_ATCC_49124               TACAAA  6
         St_thermophilus_CRISPR1                  TACAAA  6
         Lb_brevis_subsp_gravesensis_AT           TAAAG-  5
         Lb_buchneri_ATCC_11577                   TAAAG-  5
         Lb_mucosae_LM1_177_17                    TAAAG-  5
         Lb_casei                                 TGAGA-  5
         Lb_paracasei_subsp_Paracasei_8           TGAGA-  5
         Lb_paracasei_subsp_Tolerans_Lp           TGAGA-  5
         Lb_rhamnosus_GG                          TGAGA-  5
         Lb_pentosus_IG1                          TGAAA-  5
         Lb_salivarius_UCC118                     TGAAA-  5
         Lb_ruminis_ATCC_25644                    TGAAA-  5
```

St CRISPR 1 anti-stitches

St CRISPR 3 anti-stitches

Lrh anti-stitches

Lbu anti-stitches

Fig. 7

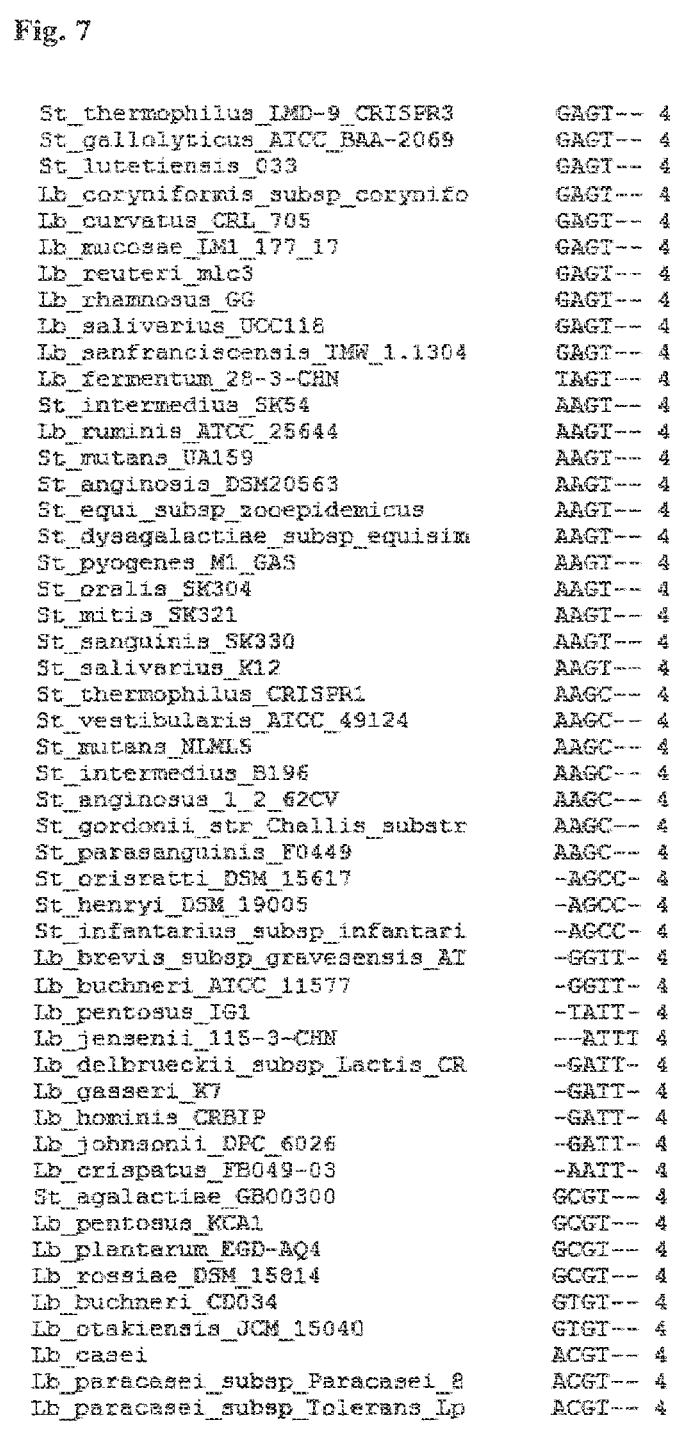

| | | |
|---|---|---|
| St_thermophilus_LMD-9_CRISPR3 | GAGT-- | 4 |
| St_gallolyticus_ATCC_BAA-2069 | GAGT-- | 4 |
| St_lutetiensis_033 | GAGT-- | 4 |
| Lb_coryniformis_subsp_corynifo | GAGT-- | 4 |
| Lb_curvatus_CRL_705 | GAGT-- | 4 |
| Lb_mucosae_LM1_177_17 | GAGT-- | 4 |
| Lb_reuteri_mlc3 | GAGT-- | 4 |
| Lb_rhamnosus_GG | GAGT-- | 4 |
| Lb_salivarius_UCC118 | GAGT-- | 4 |
| Lb_sanfranciscensis_TMW_1.1304 | GAGT-- | 4 |
| Lb_fermentum_28-3-CHN | TAGT-- | 4 |
| St_intermedius_SK54 | AAGT-- | 4 |
| Lb_ruminis_ATCC_25644 | AAGT-- | 4 |
| St_mutans_UA159 | AAGT-- | 4 |
| St_anginosis_DSM20563 | AAGT-- | 4 |
| St_equi_subsp_zooepidemicus | AAGT-- | 4 |
| St_dysagalactiae_subsp_equisim | AAGT-- | 4 |
| St_pyogenes_M1_GAS | AAGT-- | 4 |
| St_oralis_SK304 | AAGT-- | 4 |
| St_mitis_SK321 | AAGT-- | 4 |
| St_sanguinis_SK330 | AAGT-- | 4 |
| St_salivarius_K12 | AAGT-- | 4 |
| St_thermophilus_CRISPR1 | AAGC-- | 4 |
| St_vestibularis_ATCC_49124 | AAGC-- | 4 |
| St_mutans_NLML5 | AAGC-- | 4 |
| St_intermedius_B196 | AAGC-- | 4 |
| St_anginosus_1_2_62CV | AAGC-- | 4 |
| St_gordonii_str_Challis_substr | AAGC-- | 4 |
| St_parasanguinis_F0449 | AAGC-- | 4 |
| St_orisratti_DSM_15617 | -AGCC- | 4 |
| St_henryi_DSM_19005 | -AGCC- | 4 |
| St_infantarius_subsp_infantari | -AGCC- | 4 |
| Lb_brevis_subsp_gravesensis_AT | -GGTT- | 4 |
| Lb_buchneri_ATCC_11577 | -GGTT- | 4 |
| Lb_pentosus_IG1 | -TATT- | 4 |
| Lb_jensenii_115-3-CHN | ---ATTT | 4 |
| Lb_delbrueckii_subsp_Lactis_CR | -GATT- | 4 |
| Lb_gasseri_K7 | -GATT- | 4 |
| Lb_hominis_CRBIP | -GATT- | 4 |
| Lb_johnsonii_DPC_6026 | -GATT- | 4 |
| Lb_crispatus_FB049-03 | -AATT- | 4 |
| St_agalactiae_GB00300 | GCGT-- | 4 |
| Lb_pentosus_KCA1 | GCGT-- | 4 |
| Lb_plantarum_EGD-AQ4 | GCGT-- | 4 |
| Lb_rossiae_DSM_15814 | GCGT-- | 4 |
| Lb_buchneri_CD034 | GTGT-- | 4 |
| Lb_otakiensis_JCM_15040 | GTGT-- | 4 |
| Lb_casei | ACGT-- | 4 |
| Lb_paracasei_subsp_Paracasei_8 | ACGT-- | 4 |
| Lb_paracasei_subsp_Tolerans_Lp | ACGT-- | 4 |

St CRISPR 1 bulge

St CRISPR 3 bulge

Lrh bulge

Lbu bulge

Fig. 9

CLUSTAL 2.1 multiple sequence alignment

```
St_thermophilus_CRISPR1              GTTTT------TGTACTCTCAAGATTIAAGTAACTGTACAAC- 36
St_vestibularis_ATCC_49124          GTTTT------TGTACTCTCAAGATTIAAGTAACTGTACAAC- 36
St_mutans_NLML5                     GTTTT------TGTACTCTCAAGATTIAAGTAACTGTACAAC- 36
St_gordonii_str_Challis_substr      GTTTT------TGTACTCTCAAGATTIAAGTAACTGTACAAC- 36
St_anginosus_1_2_62CV               GTTTT------TGTACTCTCAAGATTIAAGTAACTGTAAAAC- 36
St_orisratti_DSM_15617              GTTTT------TGTACTCTCAAGATTIAAGTAACTGTAAAAC- 36
St_henryi_DSM_19005                 GTTTT------TGTACTCTCAAGATTIAAGTAACTGTAAAAC- 36
St_infantarius_subsp_infantari      GTTTT------TGTACTCTCAAGATTIAAGTAACCGTAAAAC- 36
St_intermedius_B196                 GTTTT------TGTACTCTCAAGATTIAAGTAACTGCAAAAC- 36
St_parasanguinis_F0449              GTTTT------TGTACTCTCAAGATTIAAGTAACTGCAAAAC- 36
Lb_rossiae_DSM_15814                GTTTAGA--TGTA-TGTCA-GATCAATAGGGTTA-AGAAC- 36
St_mutans_UA159                     GTTTTAGAGCTGTGTTGT------TTCGAATGGTTCCAAAAC- 36
St_lutetiensis_033                  GTTTTAGAGCTGTGTTGT------TTCGAATGGTTCCAAAAC- 36
St_oralis_SK304                     GTTTTAGAGCTGTGTTGT------TTCGAATGGTTCCAAAAC- 36
St_mitis_SK321                      GTTTTAGAGCTGTGTTGT------TTCGAATGGTTCCAAAAC- 36
St_sanguinis_SK330                  GTTTTAGAGCTGTGTTGT------TTCGAATGGTTCCAAAAC- 36
St_salivarius_K12                   GTTTTAGAGCTGTGTTGT------TTCGAATGGTTCCAAAAC- 36
St_thermophilus_LMD-9_CRISPR3       GTTTTAGAGCTGTGTTGT------TTCGAATGGTTCCAAAAC- 36
St_agalactiae_GB00300               GTTTTAGAGCTGTGCTGT------TTCGAATGGTTCCAAAAC- 36
St_anginosus_DSM20563               GTTTTAGAGCTGTGCTGT------TTCGAATGGTTCCAAAAC- 36
St_gallolyticus_ATCC_BAA-2069       GTTTTAGAGCTGTGCTGT------TTCGAATGGTTCCAAAAC- 36
St_pyogenes_M1_GAS                  GTTTTAGAGCTATGCTGT------TTTGAATGGTCCCAAAAC- 36
St_dysagalactiae_subsp_equisim      GTTTTAGAGCTATGTTGT------TTTGAATGGTCCCAAAAC- 36
St_equi_subsp_zooepidemicus         GTTTTAGAGTTATGCTGT------ATTGAATGGTTCCAAAAC- 36
Lb_buchneri_ATCC_11577              GCTTTAGTAGTAGTTCAA-----AACAATGATGTTTATCC--- 36
Lb_mucosae_LM1_177_17               GCTTTAGATGGATGTTAA-----ATCAATGATGTAATTCTC-- 36
Lb_brevis_subsp_gravesensis_AT      GCTTTAGTAGGATGTTAA------ATCAATGATGTTAAACCC-- 36
Lb_casei                            GTCTCAGGTAGATGTCGA-----ATCAATCAG-TTCAAGAGC- 36
Lb_paracasei_subsp_Paracasei_8      GTCTCAGGTAGATGTCGA-----ATCAATCAG-TTCAAGAGC- 36
Lb_paracasei_subsp_Tolerans_Lp      GTCTCAGGTAGATGTCGA-----ATCAATCAG-TTCAAGAGC- 36
Lb_rhamnosus_GG                     GTCTCAGGTAGATGTCAG-----ATCAATCAG-TTCAAGAGC- 36
Lb_pentosus_KCA1                    GTCTTGAATAGTAGTCAT-----ATCAAACAGGTTT-AGAAC- 36
Lb_plantarum_EGD-AQ4                GTCTTGAATAGTAGTCAT-----ATCAAACAGGTTT-AGAAC- 36
Lb_fermentum_28-3-CHN               GTCTTGGATGAGTGTCAG-----ATCAG-TAGTTCCGAGTAC- 36
Lb_reuteri_mlc3                     GTTTTAGATGTACTTCAA-----ATCAATAATGTTT-AGAAC- 36
Lb_sanfranciscensis_TMW_1.1304      GTTTTAGAAGTACGTCAT-----TCIAATGAGATTA-AGAG-- 35
Lb_ruminis_ATCC_25644               GTTTCAGCTGGATGTCAT-----ATCAATGATGTTA-TGAAC- 36
Lb_coryniformis_subsp_corynifo      GTTTTAGAAGAGTGTTAA-----ATCAATGAG-TT-TAGAACC 36
Lb_curvatus_CRL_705                 GTTTTAGAAGAGTATCAA-----ATCAATGAG-TAGTTCAAC- 36
Lb_gasseri_K7                       GTTTTAGATGGTTGTTAG-----ATCAATAAGGCTT-AGATC- 36
Lb_johnsonii_DPC_6026               GTTTTAGATGGTTGTTAG-----ATCAATAAGGTTT-AGATC- 36
Lb_hominis_CRBIP                    GTTTTAGTTAGTTGTTAG-----ATCAATAAGGTTT-AGATC- 36
Lb_crispatus_FB049-03               GTTTTAGATGATTGTTAG-----ATCAATGAGGTTT-AGATC- 36
Lb_buchneri_NRRLB-30929             GTTTTAGAAGGATGTTAA-----ATCAATAAGGTTA-AACCC- 36
Lb_otakiensis_JCM_15040             GTTTTAGAAGGATGTTAA------ATCAATAAGGTTA-AACCC- 36
Lb_pentosus_IG1                     GTTTCAGAAGGACATTAA-----ATCAATAAGGTCA-AGACC- 36
Lb_salivarius_UCC118                GTTTCAGAAGTATGTTAA-----ATCAATAAGGTTA-AGACC- 36
Lb_delbrueckii_subsp_Lactis_CR      GTTTTAGAAGGTTGTCTA-----TTCAATAAGGTTT-AACCC- 36
                                         *   *
```

Fig. 11

```
St_thermophilus_CRISPR1                -AAGCTACAAAGATAAGGCTT  20
St_vestibularis_ATCC_49124             -AAGCTACAAAGATAAGGCTT  20
St_mutans_NLML5                        -AAGCTACAAAGATAAGGCTT  20
St_intermedius_B196                    -AAGCTACAAAGATAAGGCTT  20
St_anginosus_1_2_62CV                  -AAGCTACAAAGATAAGGCTT  20
St_gordonii_str_Challis_substr         -AAGCTACAAAGATAAGGCTT  20
St_parasanguinis_F0449                 -AAGCTACAAAGATAAGGCTT  20
St_oriratti_DSM_15617                  -AGCCTACAAAGATAAGGCTT  20
St_henryi_DSM_19005                    -AGCCTACAAAGATAAGGCTT  20
St_infantarius_subsp_infantari         -AGCCTACAAAGATAAGGCTT  20
Lb_animalis_KCTC_3501                  -AAGTTA-AAA---TAAGGTTT  17
St_intermedius_SK54                    -AAGTTA-AAA---TAAGGC---  15
St_mutans_UA159                        -AAGTTA-AAA---TAAGGC---  15
St_anginosis_DSM20563                  -AAGTTA-AAA---TAAGGC---  15
St_equi_subsp_zooepidemicus            -AAGTTA-AAA---TAAGGC---  15
St_dysagalactiae_subsp_equisim         -AAGTTA-AAA---TAAGGC---  15
St_pyogenes_M1_GAS                     -AAGTTA-AAA---TAAGGC---  15
St_oralis_SK304                        -AAGTTA-AAA---TAAGGC---  15
St_mitis_SK321                         -AAGTTA-AAA---TAAGGC---  15
St_sanguinis_SK330                     -AAGTTA-AAA---TAAGGC---  15
St_salivarius_K12                      -AAGTTA-AAA---TAAGGC---  15
St_thermophilus_LMD-9_CRISPR3          -GAGTTA-AAA---TAAGGC---  15
St_agalactiae_GB00300                  -GCGTTA-AAA---TAAGGC---  15
St_gallolyticus_ATCC_BAA-2069          -GAGTTA-AAA---TAAGGC---  15
St_lutetiensis_033                     -GAGTTA-AAA---TAAGGC---  15
Lb_brevis_subsp_gravesensis_AT         -GGTTTA-AAG---TCAAACAA  17
Lb_buchneri_ATCC_11577                 -GGTTTA-AAG---TCAAACAA  17
Lb_farciminis_KCTC_3681                -AGATTA-AAA---T-AAACAA  16
Lb_casei                               -ACGTTG-AGA---TCAAACAA  17
Lb_paracasei_subsp_Paracasei_8         -ACGTTG-AGA---TCAAACAA  17
Lb_paracasei_subsp_Tolerans_Lp         -ACGTTG-AGA---TCAAACAA  17
Lb_rhamnosus_GG                        -GAGTTG-AGA---TCAAACAA  17
Lb_salivarius_UCC118                   -GAGTTG-AAA---TCAAACAA  17
Lb_pentosus_IG1                        -TATTTG-AAA---TCAAACAA  17
Lb_coryniformis_subsp_corynifo         -GAGTTA-AAA---TCAAACAA  17
Lb_curvatus_CRL_705                    -GAGTTA-AAA---TCAAACAA  17
Lb_reuteri_mlc3                        -GAGTTA-AAA---TCAAACAA  17
Lb_sanfranciscensis_TMW_1.1304         -GAGTTA-AAA---TCAAACAA  17
Lb_mucosae_LM1_177_17                  -GAGTTA-AAG---TCAAACAA  17
Lb_pentosus_KCA1                       -GCGTCA-AGA---TCAAACAA  17
Lb_plantarum_EGD-AQ4                   -GCGTCA-AGA---TCAAACAA  17
Lb_fermentum_28-3-CHN                  -TAGTCA-AGA---TCAAACGA  17
Lb_buchneri_CD034                      -GTGTTA-AAA---TCAAGCAA  17
Lb_otakiensis_JCM_15040               -GTGTTA-AAA---TCAAGCAA  17
Lb_rossiae_DSM_15814                   -GCGTTA-AAA---TCAAGCAA  17
Lb_delbrueckii_subsp_Lactis_CR         -GATTTA-AAA---TCAAGCAA  17
Lb_gasseri_K7                          -GATTTA-AAA---TCAAGCAA  17
Lb_hominis_CRBIP                       -GATTTA-AAA---TCAAGCAA  17
Lb_johnsonii_DPC_6026                  -GATTTA-AAA---TCAAGCAA  17
Lb_jensenii_115-3-CHN                  ATTTTTA-AAA---TCAAGCAA  18
Lb_crispatus_FB049-03                  -AATTTA-AAA---TCAAGCAA  17
Lb_ruminis_ATCC_25644                  -AAGTTG-AAA---TCAAGCAA  17
```

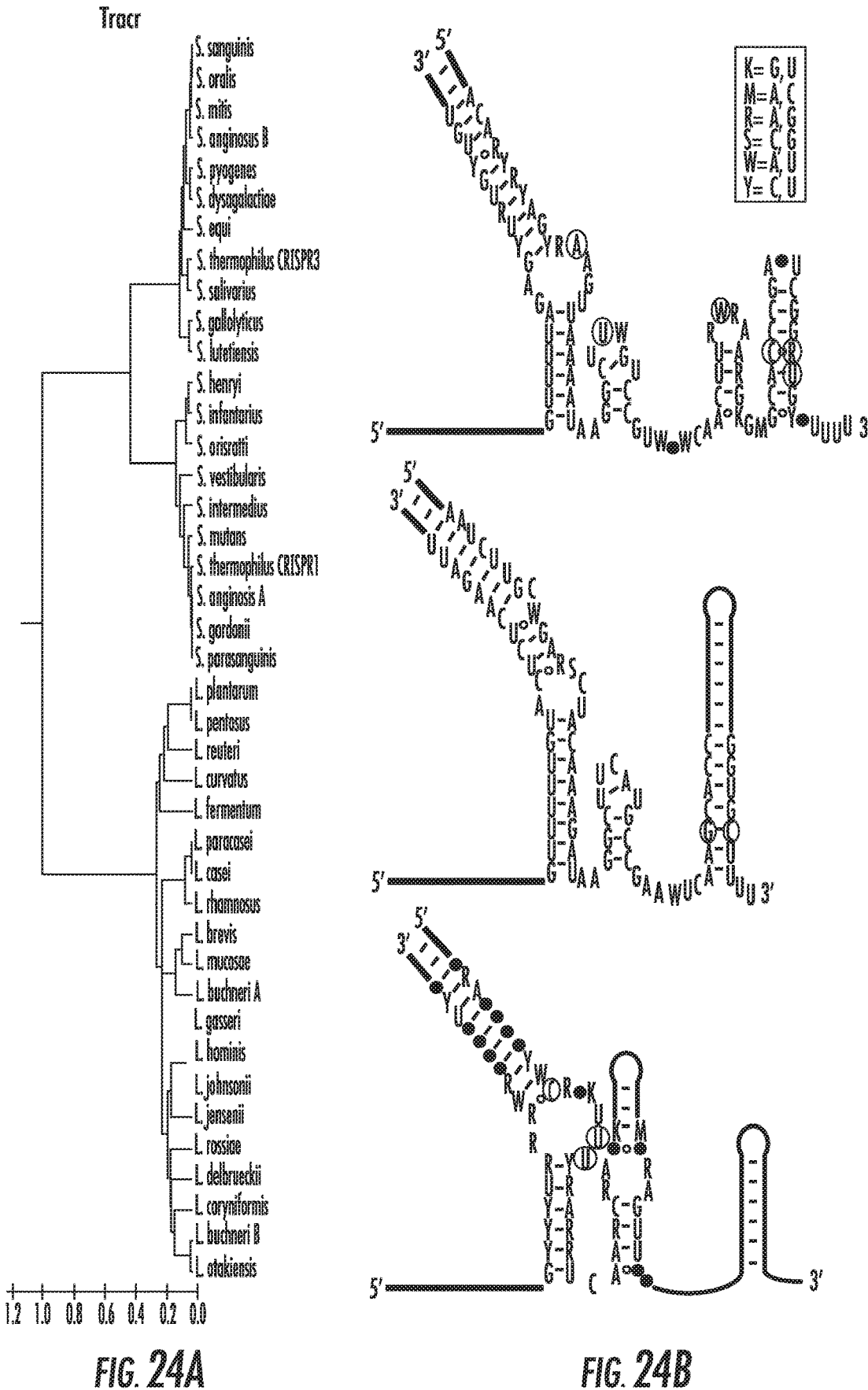
FIG. 24A                    FIG. 24B

| | | | |
|---|---|---|---|
| S. pyogenes | AAGGC----------UA-------- | GUCCGU |
| S. dysagalactiae | AAGGC----------UA-------- | GUCCGU |
| S. equi | AAGGCU---------UU-------- | GUCCGU |
| S. thermophilus CRISPR3 | AAGGCU---------UA-------- | GUCCGU |
| S. salivarius | AAGGCU---------UA-------- | GUCCGU |
| S. gallolyticus | AAGGCU---------UU-------- | GUCCGU |
| S. lutetiensis | AAGGCU---------UU-------- | GUCCGU |
| S. anginosis A | AAGGCU---------UU-------- | GUCCGU |
| S. mitis | AAGGCU---------UU-------- | GUCCGU |
| S. sanguinis | AAGGCU---------UU-------- | GUCCGU |
| S. oralis | AAGGCU---------UU-------- | GUCCGU |
| S. mutans | AAGGCU---------UC-------- | AUGCCG |
| S. intermedius | AAGGCU---------UC-------- | AUGCCG |
| S. anginosus B | AAGGCU---------UC-------- | AUGCCG |
| S. thermophilus CRISPR1 | AAGGCU---------UC-------- | AUGCCG |
| S. vestibularis | AAGGCU---------UC-------- | AUGCCG |
| S. gordonii | AAGGCU---------UC-------- | AUGCCG |
| S. parasanguinis | AAGGCU---------UC-------- | AUGCCG |
| S. orisratti | AAGGCU---------UC-------- | AUGCCG |
| S. henryi | AAGGCU---------UC-------- | AUGCCG |
| S. infantarius | AAGGCU---------UC-------- | AUGCCG |
| L. brevis | CAAACAAGGCA------GUAA-----UGCCAAGUUC |
| L. buchneri A | CAAACAAGGUA-----GCAA-----UACCAAGUUC |
| L. mucosae | CAAACAAUGCA-----UUC-----UGCAAAGUUA |
| L. curvatus | CAAACAAGGUC-----UUCG-----GACCAAGUUU |
| L. fermentum | CAAACGAGUGG-----UUUU-----CCACGAGUUA |
| L. reuteri | CAAACAAGUGC-----UUCA-----GCACAAGUUU |
| L. plantarum | CAAACAAGGCA-----UUU-----UGCCGAGUUU |
| L. pentosus | CAAACAAGGCA-----UUU-----UGCCGAGUUU |
| L. coryniformis | CAAACAAGGC------GUAA-----GCCAAGUUU |
| L. buchneri B | CAAGCAAAGCGC----UUU----GCGCGGAGUUU |
| L. otakiensis | CAAGCAAUGCGC----UUU----GCGCGGAGUUU |
| L. paracasei | CAAACAAAGCC-----UC------GGCUGAGUUU |
| L. casei | CAAACAAAGCC-----UC-----GGCUGAGUUU |
| L. rhamnosus | CAAACAAAGCU-----UC------AGCUGAGUUU |
| L. gasseri | CAAGCAAUGCAUCUUUUGAUGCAAAGUUU |
| L. hominis | CAAGCAAUGCAUCUUUUGAUGCAAAGUUU |
| L. johnsonii | CAAGCAAUGCAUCUUUUGAUGCAAAGUUU |
| L. jensenii | CAAGCAAGGCU-----UUCG-----GGCCGAGUUU |
| L. delbrueckii | CAAGCAAAGCUC-----UUCG----GAGCGGAGUUU |
| L. rossiae | CAAGCAAGGCU-----UUCG-----AGCCAAGUUU |

```
S. thermophilus CRISPR3    GTTTTAGAGCTGTGTTGTTTCGAATGGTTCCAAAAC
S. salivarius              GTTTTAGAGCTGTGTTGTTTCGAATGGTTCCAAAAC
S. sanguinis               GTTTTAGAGCTGTGTTGTTTCGAATGGTTCCAAAAC
S. mitis                   GTTTTAGAGCTGTGTTGTTTCGAATGGTTCCAAAAC
S. oralis                  GTTTTAGAGCTGTGTTGTTTCGAATGGTTCCAAAAC
S. lutetiensis             GTTTTAGAGCTGTGTTGTTTCGAATGGTTCCAAAAC
S. gallolyticus            GTTTTAGAGCTGTGCTGTTTCGAATGGTTCCAAAAC
S. equi                    GTTTTAGAGTTATGCTGTATTGAATGGTTCCAAAAC
S. pyogenes                GTTTTAGAGCTATGCTGTTTTGAATGGTCCCAAAAC
S. dysagalactiae           GTTTTAGAGCTATGTTGTTTTGAATGGTCCCAAAAC
S. anginosus B             GTTTTAGAGCTGTGCTGTTTCGAATGGTTCCAAAAC
                           ********y*ry*w*y*****y*****
```

```
S. infantarius             GTTTTTGTACTCTCAAGATTTAAGTAACCGTAAAAC
S. intermedius             GTTTTTGTACTCTCAAGATTTAAGTAACTGCAAAAC
S. parasanguinis           GTTTTTGTACTCTCAAGATTTAAGTAACTGCAAAAC
S. thermophilus CRISPR1    GTTTTTGTACTCTCAAGATTTAAGTAACTGTACAAC
S. vestibularis            GTTTTTGTACTCTCAAGATTTAAGTAACTGTACAAC
S. mutans                  GTTTTTGTACTCTCAAGATTTAAGTAACTGTACAAC
S. gordonii                GTTTTTGTACTCTCAAGATTTAAGTAACTGTACAAC
S. anginosus A             GTTTTTGTACTCTCAAGATTTAAGTAACTGTAAAAC
S. orisratti               GTTTTTGTACTCTCAAGATTTAAGTAACTGTAAAAC
S. henryi                  GTTTTTGTACTCTCAAGATTTAAGTAACTGTAAAAC
                           ************************y*y*m***
```

```
L. fermentum               GTCTTGGATGAGTGTCAGATCAGTAGTTCCGAGTAC
L. rhamnosus               GTCTCAGGTAGATGTCAGATCAATCAGTTCAAGAGC
L. casei                   GTCTCAGGTAGATGTCGAATCAATCAGTTCAAGAGC
L. paracasei               GTCTCAGGTAGATGTCGAATCAATCAGTTCAAGAGC
L. pentosus                GTCTTGAATAGTAGTCATATCAAACAGGTTTAGAAC
L. plantarum               GTCTTGAATAGTAGTCATATCAAACAGGTTTAGAAC
L. reuteri                 GTTTTAGATGTACTTCAAATCAATAATGTTTAGAAC
L. curvatus                GTTTTAGAAGAGTATCAAATCAATGAGTAGTTCAAC
L. buchneri A              GCTTTAGTAGTAGTTCAAAACAATGATGTTTTATCC
L. coryniformis            GTTTTAGAAGAGTGTTAAATCAATGAGTTTAGAACC
L. brevis                  GCTTTAGTAGGATGTTAAATCAATGATGTTAAACCC
L. mucosae                 GCTTTAGATGGATGTTAAATCAATGATGTAATTCTC
L. rossiae                 GTTTTAGATGTATGTCAGATCAATAGGGTTAAGAAC
L. hominis                 GTTTTAGTTAGTTGTTAGATCAATAACGTTTAGATC
L. gasseri                 GTTTTAGATGGTTGTTAGATCAATAAGGCTTAGATC
L. johnsonii               GTTTTAGATGGTTGTTAGATCAATAAGGTTTAGATC
L. jensenii                GTTTTAGAAGGTTGTTAAATCAGTAAGTTGAAAAAC
L. buchneri B              GTTTTAGAAGGATGTTAAATCAATAAGGTTAAACCC
L. otakiensis              GTTTTAGAAGGATGTTAAATCAATAAGGTTAAACCC
L. delbrueckii             GTTTTAGAAGGTTGTCTATTCAATAAGGTTTAACCC
                           *yyy*rrrwr....*y..ww**rw.rkk......*
```

METHODS AND COMPOSITIONS FOR SEQUENCES GUIDING Cas9 TARGETING

STATEMENT OF PRIORITY

This application is a divisional application of U.S. patent application Ser. No. 15/113,656, filed on Jul. 22, 2016, which is a 35 U.S.C. § 371 national phase application of International Application Serial No. PCT/US2015/012747, filed Jan. 23, 2015, which claims the benefit, under 35 U.S.C. § 119(e), of U.S. Provisional Application No. 61/986, 427, filed Apr. 30, 2014, and of U.S. Provisional Application No. 61/931,515, filed Jan. 24, 2014, the entire contents of each of which is incorporated by reference herein.

STATEMENT REGARDING ELECTRONIC FILING OF A SEQUENCE LISTING

A Sequence Listing in ASCII text format, submitted under 37 C.F.R. § 1.821, entitled 5051-847DV_ST25.txt, 651,891 bytes in size, generated on Jan. 16, 2024, is provided in lieu of a paper copy. This Sequence Listing is hereby incorporated by reference into the specification for its disclosures.

FIELD OF THE INVENTION

The invention relates to a synthetic CRISPR-cas system and methods of use thereof for genome editing.

BACKGROUND OF THE INVENTION

Clustered Regularly Interspaced Short Palindromic Repeats (CRISPR), in combination with associated sequences (cas) constitute the CRISPR-Cas system, which confers adaptive immunity in many bacteria. CRISPR-mediated immunization occurs through the uptake of DNA from invasive genetic elements such as plasmids and phages, as novel "spacers."

CRISPR-Cas systems consist of arrays of short DNA repeats interspaced by hypervariable sequences, flanked by cas genes, that provide adaptive immunity against invasive genetic elements such as phage and plasmids, through sequence-specific targeting and interference (Barrangou et al. 2007. *Science.* 315:1709-1712; Brouns et al. 2008. *Science* 321:960-4; Horvath and Barrangou. 2010. *Science.* 327:167-70; Marraffini and Sontheimer. 2008. *Science.* 322: 1843-1845; Bhaya et al. 2011. *Annu. Rev. Genet.* 45:273-297; Terns and Terns. 2011. *Curr. Opin. Microbiol.* 14:321-327; Westra et al. 2012. *Annu. Rev. Genet.* 46:311-339; Barrangou R. 2013. RNA. 4:267-278). Typically, invasive DNA sequences are acquired as novel "spacers" (Barrangou et al. 2007. *Science.* 315:1709-1712), each paired with a CRISPR repeat and inserted as a novel repeat-spacer unit in the CRISPR locus. Subsequently, the repeat-spacer array is transcribed as a long pre-CRISPR RNA (pre-crRNA) (Brouns et al. 2008. *Science* 321:960-4), which is processed into small interfering CRISPR RNAs (crRNAs) that drive sequence-specific recognition. Specifically, crRNAs guide nucleases towards complementary targets for sequence-specific nucleic acid cleavage mediated by Cas endonu-cleases (Garneau et al. 2010. *Nature.* 468:67-71; Haurwitz et al. 2010. *Science.* 329:1355-1358; Sapranauskas et al. 2011. *Nucleic Acid Res.* 39:9275-9282; Jinek et al. 2012. *Science.* 337:816-821; Gasiunas et al. 2012. *Proc. Natl. Acad. Sci.* 109:E2579-E2586; Magadan et al. 2012. *PLoS One.* 7:e40913; Karvelis et al. 2013. *RNA Biol.* 10:841-851). These widespread systems occur in nearly half of bacteria (~46%) and the large majority of archaea (~90%). They are classified into three main CRISPR-Cas systems types (Makarova et al. 2011. *Nature Rev. Microbiol.* 9:467-477; Makarova et al. 2013. *Nucleic Acid Res.* 41:4360-4377) based on the cas gene content, organization and variation in the biochemical processes that drive crRNA biogenesis, and Cas protein complexes that mediate target recognition and cleavage. In types I and III, the specialized Cas endonu-cleases process the pre-crRNAs, which then assemble into a large multi-Cas protein complex capable of recognizing and cleaving nucleic acids complementary to the crRNA. A different process is involved in Type II CRISPR-Cas systems. Here, the pre-CRNAs are processed by a mechanism in which a trans-activating crRNA (tracrRNA) hybridizes to repeat regions of the crRNA. The hybridized crRNA-tracrRNA are cleaved by RNase III and following a second event that removes the 5' end of each spacer, mature crRNAs are produced that remain associated with the both the tracrRNA and Cas9. The mature complex then locates a target dsDNA sequence ('protospacer' sequence) that is complementary to the spacer sequence in the complex and cuts both strands. Target recognition and cleavage by the complex in the type II system not only requires a sequence that is complementary between the spacer sequence on the crRNA-tracrRNA complex and the target 'protospacer' sequence but also requires a protospacer adjacent motif (PAM) sequence located at the 3' end of the protospacer sequence. The exact PAM sequence that is required can vary between different type II systems.

The present disclosure provides methods and compositions for increasing the efficiency and specificity of synthetic type II CRISPR-Cas systems that improve efficiency and specificity for genome editing and other uses.

SUMMARY OF THE INVENTION

One aspect of the invention provides a synthetic trans-encoded CRISPR(tracr) nucleic acid (e.g., tracrRNA, tracrDNA) construct comprising from 5' to 3', an anti-zipper sequence comprising at least about three-nucleotides; a bulge sequence comprising at least about three nucleotides; an anti-stitch sequence comprising a nucleotide sequence of NNANN; a nexus sequence comprising a nucleotide sequence of T(A/C)A(A/G)(G/A)C (or U(A/C)A(A/G)(G/A)C)), TCAAAC, (or UCAAAC), TAAGGC (or UAAGGC), GATAAGG (or GAUAAGG), GATAAGGCTT (SEQ ID NO:74) (or GAUAAGGCUU) (SEQ ID NO:295), TCAAG (or UCAAG), TCAAGCAA (or UCAAGCAA), T(C/A) AA(A/C)(C/A)(A/G)(A/T) (or U(C/A)AA(A/C)(C/A) (A/G)(A/U)), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at least one hairpin, said hairpin comprising at least three matched base pairs, wherein the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence.

A second aspect of the invention provides a synthetic CRISPR nucleic acid (e.g., crRNA, crDNA) construct comprising, from 3' to 5', a zipper sequence comprising at least about three-nucleotides that hybridizes to the anti-zipper of a tracrRNA, a bulge sequence comprising at least two nucleotides (e.g., the nucleotide sequence of (—NN—)), a stitch sequence comprising a nucleotide sequence of NNTNN (or NNUNN) that hybridizes to the anti-stitch of a tracrRNA, a $G_{R1}$ comprising a nucleotide G or GTT, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence.

A third aspect of the invention provides a synthetic CRISPR nucleic acid array comprising, a nucleotide sequence encoding two or more CRISPR nucleic acid constructs of this invention, wherein the two or more CRISPR nucleic acid constructs are located immediately adjacent to one another on said nucleotide sequence and the zipper sequences of said two or more CRISPR nucleic acid constructs are identical, the stitch sequences of said two or more CRISPR nucleic acid constructs are identical, and the spacer sequences of said two or more CRISPR nucleic acid constructs are identical or non-identical.

A fourth aspect of the invention provides a chimeric nucleic acid construct comprising the synthetic tracr nucleic acid construct of the invention and the synthetic CRISPR nucleic acid construct of the invention, wherein the zipper sequence of the synthetic CRISPR nucleic acid construct is at least about 70% complementary to and is hybridized to the anti-zipper sequence of said synthetic tracr nucleic acid construct, the stitch sequence of the synthetic CRISPR nucleic acid construct is 100% complementary to and hybridizes to the anti-stitch sequence of said synthetic tracr nucleic acid construct and the bulge sequence of the synthetic CRISPR nucleic acid construct and the bulge sequence of the synthetic CRISPR nucleic acid construct are non-complementary.

A fifth aspect of the invention provides a method for site-specific cleavage of a double stranded target DNA, comprising: contacting a chimeric nucleic acid construct of this disclosure or an expression cassette comprising said chimeric nucleic acid construct with the target DNA in the presence of a Cas9 nuclease, thereby producing a site-specific cleavage of the target DNA in a region defined by hybridization of the spacer sequence to the target DNA.

A sixth aspect of the invention provides a method for site-specific cleavage of a double stranded target DNA, comprising:

contacting a trans-encoded CRISPR (tracr) nucleic acid molecule and a CRISPR nucleic acid molecule with the target DNA in the presence of a Cas9 nuclease, wherein (a) the tracr nucleic acid molecule is encoded by a nucleotide sequence comprising from 5' to 3', an anti-zipper sequence comprising at least about three-nucleotides; a bulge sequence comprising at least about three nucleotides; an anti-stitch sequence comprising a nucleotide sequence of NNANN; a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at least two hairpins, each hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and (b) the CRISPR nucleic acid molecule is encoded by a nucleotide sequence comprising from 3' to 5', a zipper sequence comprising at least about three nucleotides, a bulge sequence comprising a nucleotide sequence having at least two nucleotides (e.g., the nucleotide sequence of (—NN—)), a stitch sequence comprising a nucleotide sequence of NNTNN (or NNUNN), a $G_{R1}$ comprising a nucleotide G or GTT, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence, and further wherein, when the anti-zipper sequence and the zipper sequence are present, they hybridize to one another, and the anti-stitch sequence and the stitch sequence hybridize to one another, and the spacer sequence of the CRISPR nucleic acid molecule is at least about 80% complementary to and hybridizes to at least a portion of the target DNA (e.g., at least about 7 consecutive nucleotides of said target DNA (e.g., about 7, 8, 9, 10, 11, 12, 13, 14, 15, 16, 17, 18, 19, 20, and the like, and any range or variation therein) and adjacent to a protospacer adjacent motif (PAM) on the target DNA, thereby resulting in a site-specific cleavage of the target DNA in a region defined by the complementary binding of the spacer sequence of the CRISPR nucleic acid molecule to the target DNA. Thus, in representative embodiments, the spacer sequence of the CRISPR nucleic acid molecule hybridizes to a portion of a target DNA sequence that is adjacent to a PAM, wherein the target sequence can comprise, consist essentially of, or consist of about 7 to about 20 consecutive nucleotides of the target DNA sequence.

A seventh aspect of the invention provides a method for site-specific cleavage of a double stranded target DNA, comprising:

contacting the double stranded target DNA with a chimeric nucleic acid comprising, (a) a first nucleotide sequence comprising from 5' to 3', an anti-zipper sequence comprising at least about three nucleotides; a bulge sequence comprising at least about three nucleotides; an anti-stitch sequence comprising a nucleotide sequence of NNANN; a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at least one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence;

(b) a second nucleotide sequence comprising from 3' to 5', a zipper sequence comprising at least about three nucleotides, which hybridizes to the anti-zipper sequence of the first nucleotide sequence, a bulge sequence comprising a nucleotide sequence having at least two nucleotides (e.g., the nucleotide sequence of (—NN—)), a stitch sequence comprising a nucleotide sequence of NNTNN (or NNUNN), a $G_{R1}$ comprising a nucleotide G or GTT, and a spacer sequence having a 5' end and a 3' end and comprising at least seven nucleotides at its 3' end that have 100% complementarity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence; and (c) a third nucleotide sequence encoding an amino acid sequence having at least 80% identity to an amino acid sequence encoding a Cas9 nuclease, wherein, when the anti-zipper sequence and zipper sequence are present, they hybridize to one another, the anti-stitch sequence hybridizes to the stitch sequence and the spacer sequence of the second nucleotide sequence hybridizes to at least a portion of the target DNA (e.g., at least about 7 consecutive nucleotides of said target DNA, preferably up to about 20 consecutive nucleotides) and adjacent to a protospacer adjacent motif (PAM) on the target DNA, thereby resulting in a site-specific cleavage of the target DNA in a region defined by the complementary binding of the spacer sequence of the second nucleotide sequence to the target DNA An eighth aspect of the invention comprises a method of site-specific targeting of a polypeptide of interest to a double stranded (ds) target DNA, comprising contacting the chimeric nucleic acid construct of this disclosure or an expression cassette comprising said chimeric nucleic acid construct with the target DNA, thereby targeting the polypeptide of interest fused to the Cas9 to a specific site on the target DNA, said site defined by hybridization of the spacer sequence to the target DNA.

A ninth aspect of the invention comprises a method of site-specific targeting of a polypeptide of interest to a double stranded (ds) target DNA, comprising contacting a trans-encoded CRISPR (tracr) nucleic acid molecule and a CRISPR nucleic acid molecule with the target DNA in the presence of a Cas9 nuclease, wherein (a) the tracr nucleic acid molecule is encoded by a nucleotide sequence comprising from 5' to 3', an anti-zipper sequence comprising at least about three nucleotides; a bulge sequence comprising at least about three nucleotides; an anti-stitch sequence comprising a nucleotide sequence of NNANN; a nexus sequence comprising a nucleotide sequence of T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at least one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and (b) the CRISPR nucleic acid molecule is encoded by a nucleotide sequence comprising from 3' to 5', a zipper sequence comprising at least about three nucleotides that hybridize to the anti-zipper sequence, a bulge sequence comprising a nucleotide sequence having at least two nucleotides (e.g., the nucleotide sequence of (—NN—)), a stitch sequence comprising a nucleotide sequence of NNTNN, a $G_{R1}$ comprising a nucleotide G or GTT, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence, and further wherein the Cas9 nuclease comprises a mutation in a HNH active site motif, a mutation in a RuvC active site motif, and is fused to a polypeptide of interest, the anti-zipper sequence and the zipper sequence hybridize to one another, the anti-stitch sequence hybridizes to the stitch sequence, and the spacer sequence hybridizes to at least a portion of the target DNA adjacent to a protospacer adjacent motif (PAM) on the target DNA, thereby resulting in a site-specific targeting of the polypeptide of interest to the target DNA in a region defined by the hybridization of the spacer sequence of the CRISPR nucleic acid molecule to the target DNA.

Further provided herein are expression cassettes, cells and kits comprising the nucleic acid constructs, nucleic acid arrays, nucleic acid molecules and/or nucleotide sequences of the invention.

These and other aspects of the invention are set forth in more detail in the description of the invention below.

BRIEF DESCRIPTION OF THE DRAWINGS

FIG. 1 shows a multiple sequence alignment for the nexus module (SEQ ID NO:74).

FIG. 3A shows the consensus sequence for the Sth Cr1 group (SEQ ID NO:80). FIG. 3B shows the consensus sequence for the Sth Cr3 group (SEQ ID NO:81). FIG. 3C shows the consensus sequence for the Lrh group (SEQ ID NO:82) and FIG. 3D shows the consensus sequence for the Lbu group (SEQ ID NO:83).

FIG. 5 shows a multiple sequence alignment for the anti-stitch module.

FIG. 6A shows the consensus sequence for the Sth Crl group. FIG. 6B shows the consensus sequence for the Sth Cr3 group. FIG. 6C shows the consensus sequence for the Lrh group and FIG. 6D shows the consensus sequence for the Lbu group.

FIG. 7 shows a multiple sequence alignment for the bulge module.

FIG. 8A shows the consensus sequence for the Sth Crl group. FIG. 8B shows the consensus sequence for the Sth Cr3 group. FIG. 8C shows the consensus sequence for the Lrh group and FIG. 8D shows the consensus sequence for the Lbu group.

FIG. 9 shows a multiple sequence alignment for the zipper module (SEQ ID NOs:84-113).

FIG. 11 shows a multiple sequence alignment for the bulge, anti-stitch and nexus modules (SEQ ID NOs:114-136).

FIG. 24A-24B shows the Cas9:sgRNA families. FIG. 24A shows a phylogenetic tree based on Cas9 protein sequences from various *Streptococcus* and *Lactobacillus* species. The sequences clustered into three families. FIG. 24B shows a consensus sequence and secondary structure of the predicted guide RNA for each family (SEQ ID NO:174-180). Each consensus RNA is composed of the crRNA (left) base-paired with the tracrRNA. Fully conserved bases are shown. Variable bases are designated by K, M, R, S, W or Y (2 possible bases) or represented by black dots (at least 3 possible bases), and base positions not always present are circled. Circles between positions indicate base pairing present in only some family members.

FIG. 25 shows CRISPR repeats sequence alignment (SEQ ID NO:181-201). For each cluster, CRISPR repeat sequence alignments are shown, with conserved and consensus nucleotides specified at the bottom of each family, with Sth3 (top), Sth1 (middle) and Lb (bottom) families.

FIG. 26 shows tracrRNA sequence alignment (SEQ ID NO:202-228). For each cluster, the experimentally determined, or computationally predicted tracrRNA sequence alignments are shown, with conserved and consensus nucleotides specified at the bottom of each family, with Sth3 (top), Sth1 (middle) and Lb (bottom) families.

FIG. 29A shows sgRNA sequences for the *Streptococcus thermophilus* CRISPR3-Cas9 (top, SEQ ID NO:267) and the *S. thermophilus* CRISPR1-Cas9 (bottom, SEQ ID NO:268). FIG. 29B shows protospacer-targeting scheme (SEQ ID NOs:269-270). The predicted PAM for each sgRNA is shown. Triangles designate the putative cut sites for each Cas9. FIG. 29C Cas9:chimeric-sgRNA orthogonality in *E. coli*. Chimeric sgRNAs. Each sgRNA (left) was subjected to the transformation assay (right) in *E. coli* expressing the SthCRISPR3 Cas9 and/or the SthCRISPR1 Cas9. Low transformation efficiencies indicate functional Cas9:sgRNA pairs through lethal self-targeting of the *E. coli* genome. Values reflect the geometric mean and S.E.M. of three independent experiments.

Figure 2:
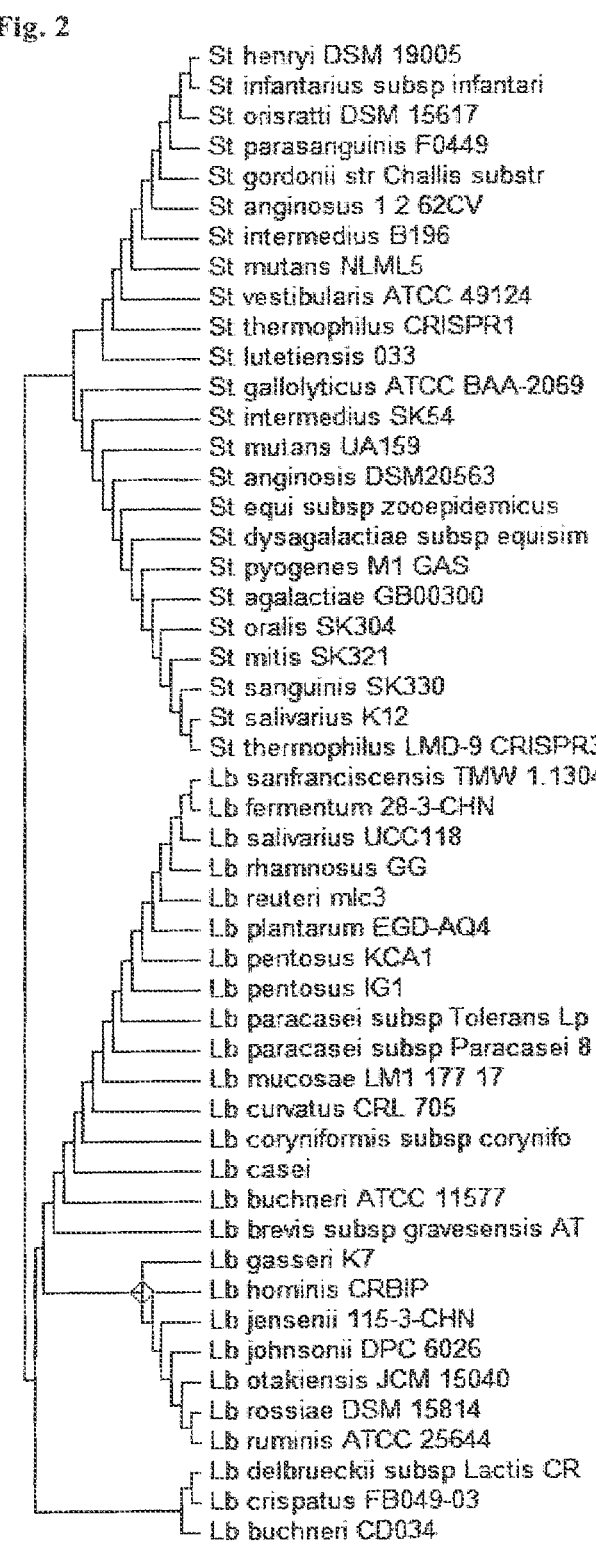
FIG. 2 shows a maximum likelihood tree for the nexus module.

*rhamnosus*. The bold sequence, flanked by a PAM light grey, italicized nucleotides) and variants thereof (SNPs, black underlined nucleotides) is the protospacer. Low transformant counts represent an active Lra CRISPR systems which precludes transformation of complementary target DNA.

DETAILED DESCRIPTION

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as a dosage or time period and the like refers to variations of ±20%, ±10%, ±5%, ±1%, ±0.5%, or even ±0.10% of the specified amount.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

The "bulge sequence" as used herein refers to non-complementary (non-hybridizing) nucleotide sequences comprised in a synthetic tracr nucleic acid construct and a synthetic CRISPR nucleic acid construct/CRISPR nucleic acid array. In the synthetic tracr nucleic acid construct, the bulge sequence is located between the anti-zipper and the anti-stitch sequences is comprised of about three nucleotides to about six nucleotides (e.g., about 3, 4, 5, 6 nucleotides; e.g., about 3 to about 6 nucleotides, about 3 to about 5 nucleotides, about 3 to about 4 nucleotides, and the like) that are non-complementary (100% non-identity) to a corresponding bulge sequence in the synthetic CRISPR nucleic acid construct/CRISPR nucleic acid array. The bulge sequence of the synthetic CRISPR nucleic acid construct/CRISPR nucleic acid array is located between the zipper and the stitch sequences and between the zipper and the stitch sequences and comprises, consists essentially of, or consists of at least two nucleotides (e.g., the nucleotide sequence of (—NN—)) (e.g., about 2, 3, 4, 5, 6 nucleotides; e.g., about 2 to about 6 nucleotides, about 2 to about 5 nucleotides, about 2 to about 4 nucleotides; about 3 to about 6 nucleotides, about 3 to about 5 nucleotides, and the like). The nucleotide composition of the bulge sequences can be any series of at least two (synthetic CRISPR nucleic acid construct/CRISPR nucleic acid array) or three or more (synthetic tracr nucleic acid construct) nucleotides as long as they are not complementary (e.g., 100% non-identity) and therefore do not hybridize to one another. As a result of the non-complementarity of the bulge sequences on the synthetic tracr nucleic acid construct and the synthetic CRISPR nucleic acid construct/CRISPR nucleic acid array, when the anti-zipper and zipper sequences and the anti-stitch and stitch sequences align and hybridize (as in the chimeric nucleic acid construct), a protrusion or bulge is formed on the synthetic tracr nucleic acid construct side of the chimeric nucleic acid construct (See, e.g., FIGS. 12-16). While not wishing to be bound by any particular theory, it is believed that the bulge structure may be involved in the functioning of the CRISPR-Cas system.

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising." "Cas9 nuclease" refers to a large group of endonucleases that catalyze the double stranded DNA cleavage in the CRISPR Cas system. These polypeptides are well known in the art and many of their structures (sequences) are characterized (See, e.g., WO2013/176772; WO/2013/188638). The domains for catalyzing the cleavage of the ds DNA are the RuvC domain and the HNH domain. The RuvC domain is responsible for nicking the (−) strand and the HNH domain is responsible for nicking the (+) strand (See, e.g., Gasiunas et al. *PNAS* 109(36):E2579-E2586 (Sep. 4, 2012)).

As used herein, "chimeric" refers to a nucleic acid molecule or a polypeptide in which at least two components are derived from different sources (e.g., different organisms, different coding regions).

"Complement" as used herein can mean 100% complementarity or identity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

The terms "complementary" or "complementarity," as used herein, refer to the natural binding of polynucleotides under permissive salt and temperature conditions by base-pairing. For example, the sequence "A-G-T" binds to the complementary sequence "T-C-A." Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

As used herein, "contact", contacting", "contacted," and grammatical variations thereof, refers to placing the components of a desired reaction together under conditions suitable for carrying out the desired reaction (e.g., integration, transformation, site-specific cleavage (nicking, cleaving), amplifying, site specific targeting of a polypeptide of interest and the like). The methods and conditions for carrying out such reactions are well known in the art (See, e.g., Gasiunas et al. (2012) *Proc. Natl. Acad. Sci.* 109: E2579-E2586; M. R. Green and J. Sambrook (2012) Molecular Cloning: A Laboratory Manual. 4th Ed., Cold Spring Harbor Laboratory Press, Cold Spring Harbor, NY).

A "fragment" or "portion" of a nucleotide sequence of the invention will be understood to mean a nucleotide sequence of reduced length relative (e.g., reduced by 1, 2, 3, 4, 5, 6, 7, 8, 9, 10, 11, 12, 13, 14, 15, 16, 17, 18, 19, 20 or more nucleotides) to a reference nucleic acid or nucleotide sequence and comprising, consisting essentially of and/or consisting of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleic acid or nucleotide sequence. Such a nucleic acid fragment or portion according to the invention may be, where appropriate, included in a larger polynucleotide of which it is a constituent. Thus, hybridizing to (or hybridizes to, and other grammatical variations thereof), for example, at least a portion of a target DNA, refers to hybridization to a nucleotide sequence that is identical or substantially identical to a length of contiguous nucleotides of the target DNA.

As used herein a "$G_{R1}$" is single nucleotide, G, or a short three nucleotide sequence, GTT, comprised on the repeat portion of crRNA or a synthetic CRISPER nucleic acid construct. The $G_{R1}$ does not hybridize with the anti-repeat of the tracrRNA or the synthetic tracr nucleic acid construct of this disclosure. In a non-canonical Watson-crick base-pairing scheme, the $G_{R1}$ may, however, form a wobble base-pair with a U at the end of the anti-CRISPR repeat portion of the tracrRNA.

As used herein, the term "gene" refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

A "hairpin sequence" as used herein, is a nucleotide sequence comprising hairpins. A hairpin (e.g., stem-loop, fold-back) refers to a nucleic acid molecule having a secondary structure that includes a region of nucleotides that form a double strand that are further flanked on either side by single stranded-regions. Such structures are well known in the art. As known in the art, the double stranded region can comprise some mismatches in base pairing or can be perfectly complementary. In some embodiments of the present disclosure, a hairpin sequence of the nucleic acid constructs is located at the 3'end of a synthetic tracr nucleic acid construct and immediately downstream of a "nexus sequence". Without being bound by any particular theory, it is believed that hairpins may be involved in Cas9 binding to a crRNA-tracrRNA complex (e.g., the synthetic CRISPR nucleic acid construct-synthetic A "heterologous" or a "recombinant" nucleotide sequence is a nucleotide sequence not naturally associated with a host cell into which it is introduced, including non-naturally occurring multiple copies of a naturally occurring nucleotide sequence.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and/or 100%) to said nucleotide sequence of the invention. Thus, for example, a homologue of a Cas9 polypeptide useful with this invention can be about 70% homologous or more to any one of the Cas9 sequences provided herein.

As used herein, hybridization, hybridize, hybridizing, and grammatical variations thereof, refer to the binding of two fully complementary nucleotide sequences or substantially complementary sequences in which some mismatched base pairs may be present. The conditions for hybridization are well known in the art and vary based on the length of the nucleotide sequences and the degree of complementarity between the nucleotide sequences. In some embodiments, the conditions of hybridization can be high stringency, or they can be medium stringency or low stringency depending on the amount of complementarity and the length of the sequences to be hybridized. The conditions that constitute low, medium and high stringency for purposes of hybridization between nucleotide sequences are well known in the art (See, e.g., Gasiunas et al. (2012) *Proc. Natl. Acad. Sci.* 109:E2579-E2586; M. R. Green and J. Sambrook (2012) Molecular Cloning: A Laboratory Manual. 4th Ed., Cold Spring Harbor Laboratory Press, Cold Spring Harbor, NY).

As used herein, the terms "increase," "increasing," "increased," "enhance," "enhanced," "enhancing," and "enhancement" (and grammatical variations thereof) describe an elevation of at least about 25%, 50%, 75%, 100%, 150%, 200%, 300%, 400%, 500% or more as compared to a control.

The terms, "invasive foreign genetic element," "invasive foreign nucleic acid" or "invasive foreign DNA" mean DNA that is foreign to the bacteria (e.g., genetic elements from, for example, pathogens including, but not limited to, viruses, bacteriophages, and/or plasmids).

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism. A "homologous" nucleic acid sequence is a nucleotide sequence naturally associated with a host cell into which it is introduced.

"Nexus sequence" as used herein refers to a nucleotide sequence located immediately downstream of the "anti-stitch sequence" in a synthetic tracr nucleic acid construct. The nexus is about six to ten nucleotides in length comprising a highly conserved sequence: TNANNC. In some embodiments, the nexus can be a nucleotide sequence of T(A/C)A(A/G)(G/A)C (or U(A/C)A(A/G)(G/A)C)), GATAAGGCTT (SEQ ID NO:74) (or GAUAAGGCUU) (SEQ ID NO:295), TCAAGCAA (or UCAAGCAA), or T(C/A)AA(A/C)(C/A)(A/G)(A/T) (or U(C/A)AA(A/C)(C/A)(A/G)(A/U)). Without being bound by any particular theory, based on the sequence conservation, it is believed that the nexus may be important in Cas9 orthogonality and recognition.

Also as used herein, the terms "nucleic acid," "nucleic acid molecule," "nucleic acid construct," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made. The nucleic acid constructs of the present disclosure can be DNA or RNA, but are preferably DNA. Thus, although the nucleic acid constructs of this invention may be described and used in the form of DNA, depending on the intended use, they may also be described and used in the form of RNA.

A "synthetic" nucleic acid or nucleotide sequence, as used herein, refers to a nucleic acid or nucleotide sequence that is not found in nature but is constructed by the hand of man and as a consequence is not a product of nature.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "oligonucleotide" and "polynucleotide" are also used interchangeably herein to refer to a heteropolymer of nucleotides. Except as otherwise indicated, nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end. Thus, for example, an element in the 3' region of a polynucleotide can be located anywhere from the first nucleotide located at the 3' end of the polynucleotide to the nucleotide located halfway through the polynucleotide.

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence.

A "protospacer sequence" refers to the target double stranded DNA and specifically to the portion of the target DNA that is fully or substantially complementary (and hybridizes) to the spacer sequence of the synthetic CRISPR nucleic acid construct.

As used herein, the terms "reduce," "reduced," "reducing," "reduction," "diminish," "suppress," and "decrease" (and grammatical variations thereof), describe, for example, a decrease of at least about 5%, 10%, 15%, 20%, 25%, 35%, 50%, 75%, 80%, 85%, 90%, 95%, 97%, 98%, 99%, or 100% as compared to a control. In particular embodiments, the reduction can result in no or essentially no (i.e., an insignificant amount, e.g., less than about 10% or even 5%) detectable activity or amount. Thus, in some embodiments, a mutation in a Cas9 nuclease can reduce the nuclease activity of the Cas9 by at least about 5%, 10%, 15%, 20%, 25%, 35%, 50%, 75%, 80%, 85%, 90%, 95%, 97%, 98%, 99%, or 100% as compared to a control (e.g., a wild-type Cas9).

A "repeat sequence" as used herein refers, for example, to the repeat sequences of wild-type CRISPR loci or of the synthetic CRISPR nucleic acid constructs that are separated by "spacer sequences." A repeat sequence can complementary (e.g., a 100% base pair match) to or substantially complementary, e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more), to a corresponding anti-repeat sequence.

A "repeat sequence" of a synthetic CRISPR nucleic acid construct of this disclosure comprises a "zipper sequence," a "bulge sequence," a "stitch sequence," and a "spacer sequence." In some embodiments, a synthetic CRISPR nucleic acid construct can comprise a $G_{R1}$ that in other embodiments is comprised in the stitch sequence.

A "zipper sequence," as used herein, refers to a portion of the repeat sequence that is located 3' or immediately upstream (3' to 5') of the bulge sequence in a synthetic CRISPR nucleic acid construct and comprises, consists of, or consists essentially of at least about three nucleotides (e.g., 3, 4, 5, 6, 7, 8, 9, 10, 11, 12, 13, 14, 15, 16, 17, 18, 19, 20, 21, 22, 23, 24, 25, 26, 27, 28, 29, 30 or more nucleotides, or any range or value therein). In some embodiments, a zipper sequence can be referred to as the "upper stem." A "zipper sequence" shares sufficient complementarity with a corresponding "anti-zipper sequence" located on a synthetic tracr nucleic acid construct such that upon contact the zipper sequence and the anti-zipper sequence and can hybridize to one another, thereby binding the two nucleic acid constructs together. In some embodiments, the zipper/anti-zipper sequence can be referred to as an "upper stem." A zipper sequence can be fully complementary (e.g., a 100% base pair match) to or substantially complementary, e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more) to the corresponding anti-zipper sequence. Accordingly, an anti-zipper sequence of a synthetic tracr nucleic acid construct of this invention comprises, consists of, or consists essentially of at least about three nucleotides (e.g., about 3, 4, 5, 6, 7, 8, 9, 10, 11, 12, 13, 14, 15, 16, 17, 18, 19, 20, 21, 22, 23, 24, 25, 26, 27, 28, 29, 30 or more nucleotides, or any range or value therein) that are fully complementary to or substantially complementary to the corresponding zipper sequence in a synthetic CRISPR nucleic acid construct or a synthetic CRISPR nucleic acid array. The anti-zipper sequence is the site of RNase III binding and as such comprises the nucleotide sequences that are well known in the art to be involved in RNase III binding (See, e.g., Pertzev and Nicholson, *Nucleic Acids Res.* 34(13):3708-3721(2006)).

As used herein "sequence identity" refers to the extent to which two optimally aligned polynucleotide or peptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); Sequence Analysis in Molecular Biology (von Heinje, G., ed.) Academic Press (1987); and Sequence Analysis Primer (Gribskov, M. and Devereux, J., eds.) Stockton Press, New York (1991).

A "spacer sequence" as used herein is a nucleotide sequence that is complementary to a target DNA (e.g., the "protospacer sequence"). The spacer sequence can be fully complementary or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a target DNA. In representative embodiments, the spacer sequence has 100% complementarity to the target DNA. In additional embodiments, the complementarity of the 3' region of the spacer sequence to the target DNA is 100% but is less than 100% in the 5' region of the spacer and therefore the overall complementarity of the spacer sequence to the target DNA is less than 100%. Thus, for example, the first 7, 8, 9, 10, 11, 12, 13, 14, 15, 16, and the like, nucleotides in the 3' region of a 20 nucleotide spacer sequence (seed sequence) can be 100% complementary to the target DNA, while the remaining nucleotides in the 5' region of the spacer sequence are substantially complementary (e.g., at least about 70% complementary) to the target DNA. In some embodiments, the first 7 to 12 nucleotides of the spacer sequence can be 100% complementary to the target DNA, while the remaining nucleotides in the 5' region of the spacer sequence are substantially complementary (e.g., at least about 70% complementary) to the target DNA. In other embodiments, the first 7 to 10 nucleotides of the spacer sequence can be 100% complementary to the target DNA, while the remaining nucleotides in the 5' region of the spacer sequence are substantially complementary (e.g., at least about 70% complementary) to the target DNA. In representative embodiments, the first 7 nucleotides of the spacer sequence can be 100% complementary to the target DNA, while the remaining nucleotides in the 5' region of the spacer sequence are substantially complementary (e.g., at least about 70% complementary) to the target DNA.

A "stitch sequence" as used herein refers to a nucleotide sequence comprising, consisting essentially of, or consisting of about 5 nucleotides in length and having the consensus nucleotide sequence of NNTNN. The "stitch sequence" is located (5' to 3') on a synthetic CRISPR nucleic acid construct immediately upstream of the "bulge sequence" and downstream of the "$G_{R1}$". The "stitch sequence" tends to have a high AT content and hybridizes to the "anti-stitch sequence" located in the synthetic tracr nucleic acid construct. In some particular embodiments, the stitch sequence comprises, consists essentially of, or consists of the nucleotide sequence of (5' to 3') NNTNN, TTTGT, TTTTA, (T/C)(T/C)T(T/C)(T/G), TTTTA, TTTCA.

An "anti-stitch sequence" as used herein, refers to a nucleotide sequence that is fully complementary to and hybridizes to the stitch sequence (e.g., NNANN, ACAAA, TAAAA, (T/C)(A/G)T(A/G)(A/G), TAAAA, TGAAA). The anti-stitch sequence is located on a synthetic tracr nucleic acid construct immediately downstream (5' to 3') of the bulge sequence and immediately upstream of the "nexus sequence." Without wishing to be bound by any particular theory, it is believed that the hybridization of the stitch sequence of the synthetic crRNA construct with the anti-stitch sequence of synthetic tracrRNA construct is involved in re-establishing base-pairing after the "bulge sequence." In some embodiments, the stitch/anti-stitch can be referred to as the "lower stem."

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and/or 100% nucleotide or amino acid residue identity, when compared and aligned for maximum correspondence, as measured using one of the following sequence comparison algorithms or by visual inspection. In some embodiments of the invention, the substantial identity exists over a region of the sequences that is at least about 50 residues to about 150 residues in length. Thus, in some embodiments of the invention, the substantial identity exists over a region of the sequences that is at least about 3 to about 15 (e.g., 3, 4, 5, 6, 7, 8, 9, 10, 11, 12, 13, 14, 15 residues in length and the like or any value or any range therein), at least about 5 to about 30, at least about 10 to about 30, at least about 16 to about 30, at least about 18 to at least about 25, at least about 18, at least about 22, at least about 25, at least about 30, at least about 40, at least about 50, about 60, about 70, about 80, about 90, about 100, about 110, about 120, about 130, about 140, about 150, or more residues in length, and any range therein. In representative embodiments, the sequences can be substantially identical over at least about 22 nucleotides. In some particular embodiments, the sequences are substantially identical over at least about 150 residues. In some embodiments, sequences of the invention can be about 70% to about 100% identical over at least about 16 nucleotides to about 25 nucleotides. In some embodiments, sequences of the invention can be about 75% to about 100% identical over at least about 16 nucleotides to about 25 nucleotides. In further embodiments, sequences of the invention can be about 80% to about 100% identical over at least about 16 nucleotides to about 25 nucleotides. In further embodiments, sequences of the invention can be about 80% to about 100% identical over at least about 7 nucleotides to about 25 nucleotides. In some embodiments, sequences of the invention can be about 70% identical over at least about 18 nucleotides. In other embodiments, the sequences can be about 85% identical over about 22 nucleotides. In still other embodiments, the sequences can be 100% homologous over about 16 nucleotides. In a further embodiment, the sequences are substantially identical over the entire length of the coding regions. Furthermore, in representative embodiments, substantially identical nucleotide or protein sequences perform substantially the same function (e.g., Cas9 HNH and/or RuvC nickase activities).

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, CA). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89: 10915 (1989)).

In addition to calculating percent sequence identity, the BLAST algorithm also performs a statistical analysis of the similarity between two sequences (see, e.g., Karlin & Altschul, *Proc. Nat. Acad. Sci. USA* 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleotide sequence to the reference nucleotide sequence is less than about 0.1 to less than about 0.001. Thus, in some embodiments of the invention, the smallest sum probability in a comparison of the test nucleotide sequence to the reference nucleotide sequence is less than about 0.001.

Two nucleotide sequences can also be considered to be substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology-Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

The following are examples of sets of hybridization/wash conditions that may be used to clone homologous nucleotide sequences that are substantially identical to reference nucleotide sequences of the invention. In one embodiment, a reference nucleotide sequence hybridizes to the "test" nucleotide sequence in 7% sodium dodecyl sulfate (SDS), 0.5 M NaPO₄, 1 mM EDTA at 50° C. with washing in 2×SSC, 0.1% SDS at 50° C. In another embodiment, the reference nucleotide sequence hybridizes to the "test" nucleotide sequence in 7% sodium dodecyl sulfate (SDS), 0.5 M NaPO₄, 1 mM EDTA at 50° C. with washing in 1×SSC, 0.1% SDS at 50° C. or in 7% sodium dodecyl sulfate (SDS), 0.5 M NaPO₄, 1 mM EDTA at 50° C. with washing in 0.5×SSC, 0.1% SDS at 50° C. Instill further embodiments, the reference nucleotide sequence hybridizes to the "test" nucleotide sequence in 7% sodium dodecyl sulfate (SDS), 0.5 M NaPO₄, 1 mM EDTA at 50° C. with washing in 0.1×SSC, 0.1% SDS at 50° C., or in 7% sodium dodecyl sulfate (SDS), 0.5 M NaPO₄, 1 mM EDTA at 50° C. with washing in 0.1×SSC, 0.1% SDS at 65° C.

Any nucleotide sequence and/or recombinant nucleic acid molecule of this invention can be codon optimized for expression in any species of interest. Codon optimization is well known in the art and involves modification of a nucleotide sequence for codon usage bias using species specific codon usage tables. The codon usage tables are generated based on a sequence analysis of the most highly expressed genes for the species of interest. When the nucleotide sequences are to be expressed in the nucleus, the codon usage tables are generated based on a sequence analysis of highly expressed nuclear genes for the species of interest. The modifications of the nucleotide sequences are determined by comparing the species specific codon usage table with the codons present in the native polynucleotide sequences. As is understood in the art, codon optimization of a nucleotide sequence results in a nucleotide sequence having less than 100% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like) to the native nucleotide sequence but which still encodes a polypeptide having the same function as that encoded by the original, native nucleotide sequence. Thus, in representative embodiments of the invention, the nucleotide sequence and/or recombinant nucleic acid molecule of this invention can be codon optimized for expression in the particular species of interest.

In some embodiments, the recombinant nucleic acids molecules, nucleotide sequences and polypeptides of the invention are "isolated." An "isolated" nucleic acid molecule, an "isolated" nucleotide sequence or an "isolated" polypeptide is a nucleic acid molecule, nucleotide sequence or polypeptide that, by the hand of man, exists apart from its native environment and is therefore not a product of nature. An isolated nucleic acid molecule, nucleotide sequence or polypeptide may exist in a purified form that is at least partially separated from at least some of the other components of the naturally occurring organism or virus, for example, the cell or viral structural components or other polypeptides or nucleic acids commonly found associated with the polynucleotide. In representative embodiments, the isolated nucleic acid molecule, the isolated nucleotide sequence and/or the isolated polypeptide is at least about 1%, 5%, 10%, 20%, 30%, 40%, 50%, 60%, 70%, 80%, 90%, 95%, or more pure.

In other embodiments, an isolated nucleic acid molecule, nucleotide sequence or polypeptide may exist in a non-native environment such as, for example, a recombinant host cell. Thus, for example, with respect to nucleotide sequences, the term "isolated" means that it is separated from the chromosome and/or cell in which it naturally occurs. A polynucleotide is also isolated if it is separated from the chromosome and/or cell in which it naturally occurs in and is then inserted into a genetic context, a chromosome and/or a cell in which it does not naturally occur (e.g., a different host cell, different regulatory sequences, and/or different position in the genome than as found in nature). Accordingly, the recombinant nucleic acid molecules, nucleotide sequences and their encoded polypeptides are "isolated" in that, by the hand of man, they exist apart from their native environment and therefore are not products of nature, however, in some embodiments, they can be introduced into and exist in a recombinant host cell.

In any of the embodiments described herein, the nucleotide sequences and/or recombinant nucleic acid molecules of the invention can be operatively associated with a variety of promoters and other regulatory elements for expression in various organisms cells. Thus, in representative embodiments, a recombinant nucleic acid of this invention can further comprise one or more promoters operably linked to one or more nucleotide sequences.

By "operably linked" or "operably associated" as used herein, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence, means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to the nucleotide sequence.

A "promoter" is a nucleotide sequence that controls or regulates the transcription of a nucleotide sequence (i.e., a coding sequence) that is operably associated with the promoter. The coding sequence may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. The promoter region may comprise other elements that act as regulators of gene expression. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227).

Promoters can include, for example, constitutive, inducible, temporally regulated, developmentally regulated, chemically regulated, tissue-preferred and/or tissue-specific promoters for use in the preparation of recombinant nucleic acid molecules, i.e., "chimeric genes" or "chimeric polynucleotides." These various types of promoters are known in the art.

The choice of promoter will vary depending on the temporal and spatial requirements for expression, and also depending on the host cell to be transformed. Promoters for many different organisms are well known in the art. Based on the extensive knowledge present in the art, the appropriate promoter can be selected for the particular host organism of interest.

Thus, for example, much is known about promoters upstream of highly constitutively expressed genes in model organisms and such knowledge can be readily accessed and implemented in other systems as appropriate.

In some embodiments, a nucleic acid construct of the invention can be an "expression cassette" or can be comprised within an expression cassette. As used herein, "expression cassette" means a recombinant nucleic acid molecule comprising a nucleotide sequence of interest (e.g., the nucleic acid constructs of the invention (e.g., a synthetic tracr nucleic acid construct, a synthetic CRISPR nucleic acid construct, a synthetic CRISPR array, a chimeric nucleic acid construct; a nucleotide sequence encoding a polypeptide of interest, a nucleotide sequence encoding a cas9 nuclease)), wherein said nucleotide sequence is operably associated with at least a control sequence (e.g., a promoter). Thus, some aspects of the invention provide expression cassettes designed to express the nucleotides sequences of the invention.

An expression cassette comprising a nucleotide sequence of interest may be chimeric, meaning that at least one of its components is heterologous with respect to at least one of its other components. An expression cassette may also be one that is naturally occurring but has been obtained in a recombinant form useful for heterologous expression.

An expression cassette also can optionally include a transcriptional and/or translational termination region (i.e., termination region) that is functional in the selected host cell. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operably linked nucleotide sequence of interest, may be native to the host cell, or may be derived from another source (i.e., foreign or heterologous to the promoter, to the nucleotide sequence of interest, to the host, or any combination thereof).

An expression cassette also can include a nucleotide sequence for a selectable marker, which can be used to select a transformed host cell. As used herein, "selectable marker" means a nucleotide sequence that when expressed imparts a distinct phenotype to the host cell expressing the marker and thus allows such transformed cells to be distinguished from those that do not have the marker. Such a nucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Of course, many examples of suitable selectable markers are known in the art and can be used in the expression cassettes described herein.

In addition to expression cassettes, the nucleic acid molecules and nucleotide sequences described herein can be used in connection with vectors. The term "vector" refers to a composition for transferring, delivering or introducing a nucleic acid (or nucleic acids) into a cell. A vector comprises a nucleic acid molecule comprising the nucleotide sequence (s) to be transferred, delivered or introduced. Vectors for use in transformation of host organisms are well known in the art. Non-limiting examples of general classes of vectors include but are not limited to a viral vector, a plasmid vector, a phage vector, a phagemid vector, a cosmid vector, a fosmid vector, a bacteriophage, an artificial chromosome, or an *Agrobacterium* binary vector in double or single stranded linear or circular form which may or may not be self transmissible or mobilizable. A vector as defined herein can transform prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some representative embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell. Accordingly, the nucleic acid molecules of this invention and/or expression cassettes can be comprised in vectors as described herein and as known in the art.

"Introducing," "introduce," "introduced" (and grammatical variations thereof) in the context of a polynucleotide of interest means presenting the nucleotide sequence of interest to the host organism or cell of said organism (e.g., host cell) in such a manner that the nucleotide sequence gains access to the interior of a cell. Where more than one nucleotide sequence is to be introduced these nucleotide sequences can be assembled as part of a single polynucleotide or nucleic acid construct, or as separate polynucleotide or nucleic acid constructs, and can be located on the same or different expression constructs or transformation vectors. Accordingly, these polynucleotides can be introduced into cells in a single transformation event, in separate transformation/transfection events, or, for example, they can be incorporated into an organism by conventional breeding protocols. Thus, in some aspects of the present invention one or more nucleic acid constructs of this invention (e.g., a synthetic tracr nucleic acid construct, a synthetic CRISPR nucleic acid construct, a synthetic CRISPR array, a chimeric nucleic acid construct; a nucleotide sequence encoding a polypeptide of interest, a nucleotide sequence encoding a cas9 nuclease, and the like) can be introduced into a host organism or a cell of said host organism.

The term "transformation" or "transfection" as used herein refers to the introduction of a heterologous nucleic acid into a cell. Transformation of a cell may be stable or transient. Thus, in some embodiments, a host cell or host organism is stably transformed with a nucleic acid molecule of the invention. In other embodiments, a host cell or host organism is transiently transformed with a recombinant nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein also includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant, a mammal, an insect, an archaea, a bacterium, and the like). Stable transformation of a cell can be detected by, for example, a Northern blot hybridization assay of RNA of the cell with nucleic acid sequences which specifically hybridize with a nucleotide sequence of a transgene introduced into a plant or other organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, the nucleotide sequences, constructs, expression cassettes can be expressed transiently and/or they can be stably incorporated into the genome of the host organism.

A recombinant nucleic acid molecule/polynucleotide of the invention can be introduced into a cell by any method known to those of skill in the art. In some embodiments of the invention, transformation of a cell comprises nuclear transformation. In other embodiments, transformation of a cell comprises plastid transformation (e.g., chloroplast transformation). In still further embodiments, the recombinant nucleic acid molecule/polynucleotide of the invention can be introduced into a cell via conventional breeding techniques.

Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocol* 8:2281-2308 (2013))

A nucleotide sequence therefore can be introduced into a host organism or its cell in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, or in separate transformation events, or, alternatively, where relevant, a nucleotide sequence can be incorporated into a plant, as part of a breeding protocol.

The present invention is directed to compositions and methods having increased efficiency and increased specificity for site-specific nicking, cleaving and/or modification of target DNA and for site-specific targeting of polypeptides of interest to target DNA.

Figure 20:
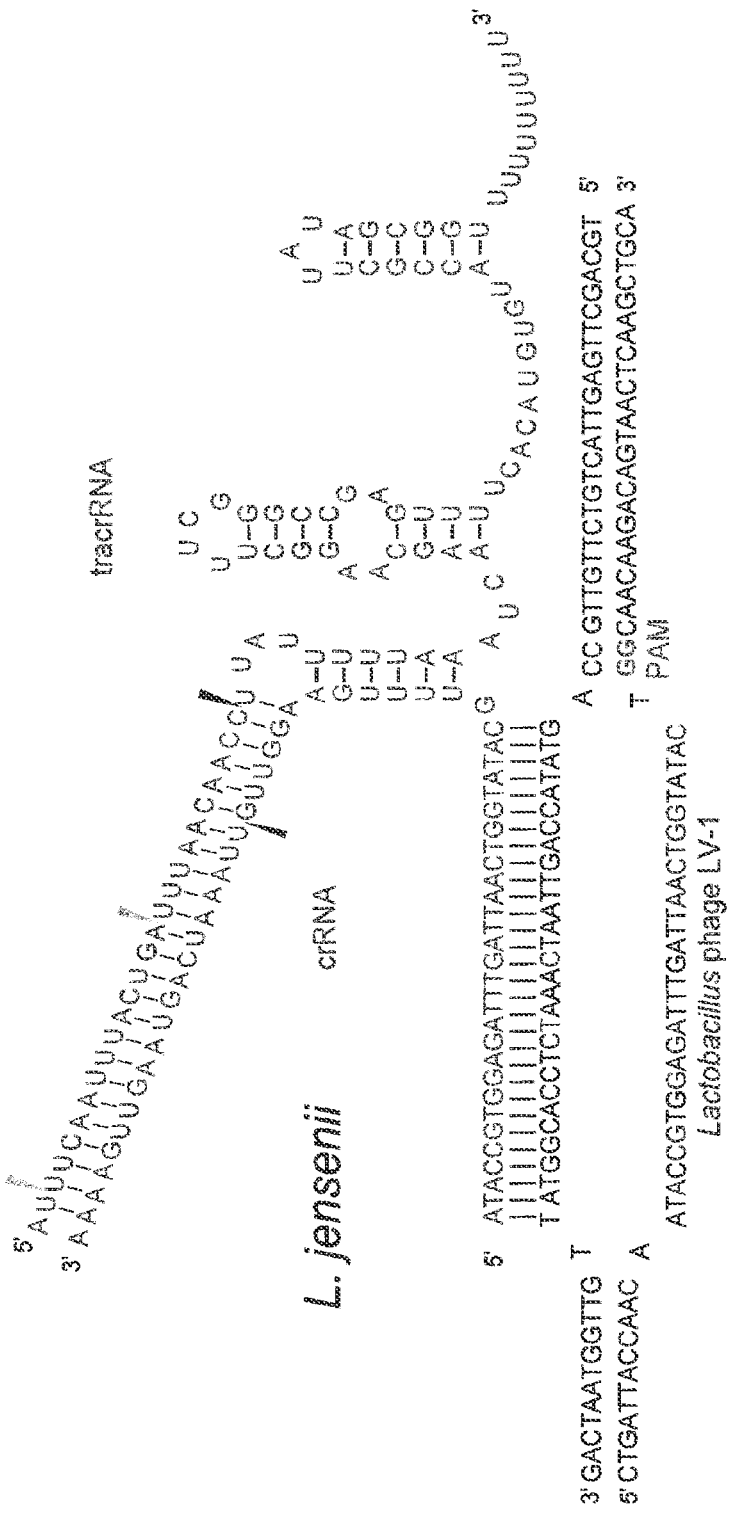
FIG. 20 shows sequence and structural details for CRISPR-Cas system elements for the *Lactobacillus jensenii*, representing the Lje group (SEQ ID NOs:166-169).
Figure 22:
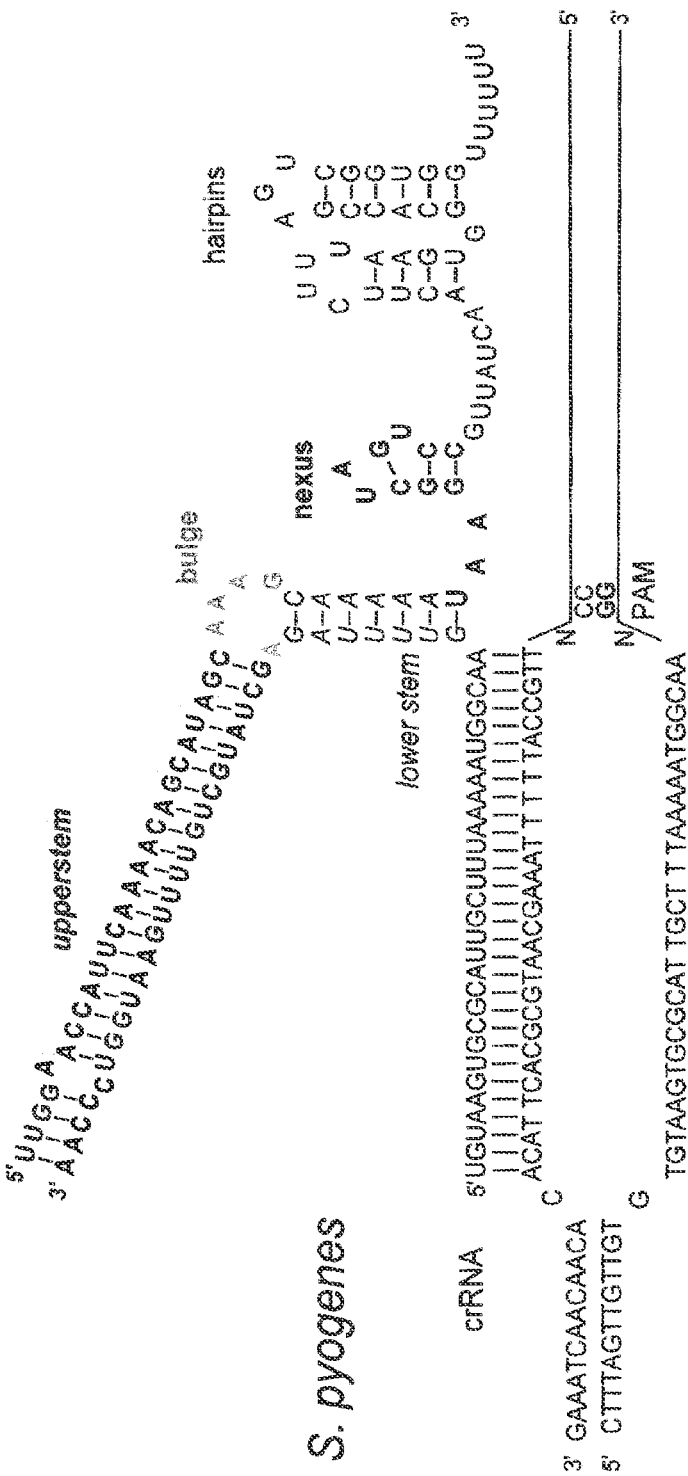
FIG. 22 shows sequence and structural details for CRISPR-Cas system elements for *Streptococcus* pyrogenes M1 GAS (SEQ ID NOs:61 and 147-149).

The nucleic acid constructs and nucleotide sequences of the invention can be described in alternative ways that do not impact the overall structure or function of the constructs or sequences. Thus, for example, in some instances the synthetic CRISPR nucleic acid (crRNA) can comprise a wobble base $G_{R1}$ sequence (G/U) and a stitch sequence or alternatively, the crRNA can comprise a stitch sequence that comprises the (G/U) wobble base and therefore does not further describe a $G_{R1}$ sequence. In some cases, the GR1 does not pair (i.e. G/A mismatch with Lje, FIG. 20). Further equivalencies include those as shown in the equivalency table (Table 1) provided below (see also, FIG. 22).

TABLE 1

Equivalencies for sequences as described herein.

| Original Nomenclature | Alternative Nomenclature |
| --- | --- |
| G$_{R1}$ | Comprised at the 5' end of the stitch. |
| Nexus comprises a "T" at the 5' end | The anti-stitch comprises what was the 5' "T" of the nexus and is extended to encompass at least an additional 6 nucleotides (e.g., AAGGCTAGTCC(GU)(SEQ ID NO: 296); stitch and anti-stitch alternatively referred to as the "lower stem" |
| Bulge | Same (bulge) |
| Zipper/anti-zipper | Same (alternatively, referred to as the upper stem) with some differences in the overall length; zipper/anti-zipper alternatively referred to as "upper stem" |
| Stitch/anti-stitch | The anti-stitch comprises the 5' "T" of the nexus in the original nomenclature, which "T" can, in some embodiments, wobble base pair with the (G/A) of the stitch (G$_{R1}$ in original nomenclature) |
| Hairpin sequence | Some of the 5' nucleotides of the hairpin sequence are re-assigned to the nexus |

Accordingly, in one aspect of the invention a synthetic trans-encoded CRISPR (tracr) nucleic acid (e.g., tracrRNA, tracrDNA) construct is provided, said construct comprising, consisting essentially of, or consisting of from 5' to 3', an anti-zipper sequence comprising, consisting essentially of or consisting of at least about three nucleotides; a bulge sequence comprising at least about three nucleotides; an anti-stitch sequence comprising a nucleotide sequence of NNANN; a nexus sequence comprising a nucleotide sequence of TNANNC, T(A/C)A(A/G)(G/A)C (or U(A/C) A(A/G)(G/A)C)), TCAAAC, (or UCAAAC), TAAGGC (or UAAGGC), GATAAGG (or GAUAAGG), GATAAGGCTT (SEQ ID NO:74) (or GAUAAGGCUU) (SEQ ID NO:295), TCAAG (or UCAAG), TCAAGCAA (or UCAAGCAA), T(C/A)AA(A/C)(C/A)(A/G)(A/T) (or U(C/A)AA(A/C)(C/ A)(A/G)(A/U)), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at least one hairpin, said hairpin comprising at least three matched base pairs, wherein the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence. In some embodiments, the anti-stitch sequence an comprise, consist essentially of, or consist of a nucleotide sequence of NNANN, ACAAA, TAAAA, (T/C) (A/G)T(A/G)(A/G), TAAAA, TGAAA.

In a further embodiment, a synthetic trans-encoded CRIS-PR(tracr) nucleic acid construct is provided, comprising, consisting essentially of, or consisting of from 5' to 3', an anti-zipper sequence comprising at least about three nucleotides; a bulge sequence comprising at least about three nucleotides; an anti-stitch sequence comprising a nucleotide sequence of NNANN; a nexus sequence comprising consisting essentially of, or consisting of a nucleotide sequence of TNANNC, T(A/C)A(A/G)(G/A)C (or U(A/C)A(A/G)(G/ A)C)), TCAAAC, (or UCAAAC), TAAGGC (or UAAGGC), GATAAGG (or GAUAAGG), GATAAGGCTT (SEQ ID NO:74) (or GAUAAGGCUU) (SEQ ID NO:295), TCAAG (or UCAAG), TCAAGCAA (or UCAAGCAA), T(C/A)AA(A/C)(C/A)(A/G)(A/T) (or U(C/A)AA(A/C)(C/ A)(A/G)(A/U)), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78), and a hairpin sequence comprising a nucleotide sequence having at least one hairpin, said hairpin comprising at least three matched base pairs, wherein the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence.

In some embodiments, the bulge sequence of a synthetic tracr nucleic acid construct comprises, consists essentially of or consists of at least about three nucleotides. In some embodiments, the bulge sequence of a synthetic tracr nucleic acid construct comprises, consists essentially of or consists of at least about four nucleotides. In other embodiments, the bulge sequence of a synthetic tracr nucleic acid construct comprises, consists essentially of or consists of five nucleotides. In other embodiments, the hairpin sequence of a synthetic tracr nucleic acid construct comprises, consists essentially of or consists of at least two hairpins, wherein each hairpin comprises at least three matched base pairs.

In a further aspect, the present invention provides a synthetic CRISPR nucleic acid (e.g., crRNA, crDNA) construct comprising, consisting essentially of, or consisting of from 3' to 5', a zipper sequence comprising, consisting essentially of, or consisting of at least about three nucleotides, a bulge sequence that comprises, consists essentially of, or consists of a nucleotide sequence having at least two nucleotides (e.g., the nucleotide sequence of (—NN—)), a stitch sequence comprising, consisting essentially of, or consisting of a nucleotide sequence of NNTNN (or NNUNN), a G$_{R1}$ comprising, consisting essentially of, or consisting of a nucleotide G or GTT, and a spacer sequence having a 5' end and a 3' end and comprising, consisting essentially of, or consisting of at least seven nucleotides at its 3' end that have 100% identity to a target DNA, and the zipper sequence is located immediately upstream of the bulge sequence, the bulge sequence is located immediately upstream of the stitch sequence, the stitch sequence is located immediately upstream of the G$_{R1}$, and the G$_{R1}$ is located immediately upstream of the spacer sequence.

In a further embodiment, synthetic CRISPR nucleic acid (e.g., crRNA, crDNA) construct is provided, comprising, consisting essentially of, or consisting of, from 3' to 5', a zipper sequence comprising a nucleotide sequence having at least three nucleotides that hybridize to the anti-zipper, a bulge sequence that comprises the nucleotide sequence of at least about two nucleotides, a stitch sequence comprising a nucleotide sequence of NNUNN (, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the spacer sequence.

In some embodiments, a synthetic CRISPR nucleic acid array is provided, said synthetic CRISPR nucleic acid array comprising, a nucleotide sequence encoding two or more CRISPR nucleic acid constructs of this invention, wherein the two or more CRISPR nucleic acid constructs are located immediately adjacent to one another on said nucleotide sequence, the stitch sequences of said two or more CRISPR nucleic acid constructs are identical, the spacer sequences of said two or more CRISPR nucleic acid constructs are identical or non-identical, and the zipper sequences of said two or more CRISPR nucleic acid constructs are identical.

In other aspects, a chimeric nucleic acid construct (or guide nucleic acid construct) is provided, comprising a synthetic tracr nucleic acid construct and a synthetic CRISPR nucleic acid construct of this invention, wherein the zipper sequence of the synthetic CRISPR nucleic acid construct is at least about 70% (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like) complementary to and hybridizes to the anti-zipper sequence of said synthetic tracr nucleic acid construct, the stitch sequence of the synthetic CRISPR nucleic acid construct is 100% identical to and hybridized to the anti-stitch sequence of said synthetic tracr nucleic acid construct and the bulge sequence of the synthetic CRISPR nucleic acid construct and the bulge sequence of the synthetic CRISPR nucleic acid construct are non-complementary.

In other embodiments, a chimeric nucleic acid construct is provided comprising, consisting essentially of, or consisting of, a synthetic tracr nucleic acid construct and a synthetic CRISPR nucleic acid construct of this invention, wherein the NNUNN of the stitch sequence of the synthetic CRISPR nucleic acid construct is 100% complementary to and hybridizes to the NNANN of the anti-stitch sequence of said synthetic tracr nucleic acid construct and the (G) of said stitch sequence forms a wobble base pair with the U of said anti-stitch sequence, the bulge sequence of the synthetic CRISPR nucleic acid construct and the bulge sequence of the synthetic CRISPR nucleic acid construct are non-complementary and, when the zipper sequence and anti-zipper sequence are present, the zipper sequence of the synthetic CRISPR nucleic acid construct is hybridized to the anti-zipper sequence of said synthetic tracr nucleic acid construct.

In some embodiments, a chimeric nucleic acid construct can optionally further comprise nucleotides linking the hybridized zipper and the anti-zipper sequence at the end of the hybridized sequences that is distal to the bulge sequences. A linking nucleotide can be any nucleotide (e.g., T, A, G, C) and the number of nucleotides linking the zipper sequence and anti-zipper sequence or the bulge sequence can be about three to about seven.

In further aspects, a synthetic tracr nucleic acid construct, a synthetic CRISPR nucleic acid construct, a CRISPR nucleic acid array, or a chimeric nucleic acid construct of the invention can further comprise a Cas9 nuclease, nucleotide sequence encoding an amino acid sequence having at least 70% identity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like) to an amino acid sequence encoding a Cas9 nuclease or an amino acid sequence having at least 70% identity to an amino acid sequence encoding a Cas9 nuclease. Cas9 nucleases useful with this invention can be any Cas9 nuclease known to catalyze DNA cleavage in a CRISPR-Cas system. As known in the art, such Cas9 nucleases comprise a HNH motif and a RuvC motif (See, e.g., WO2013/176772; WO/2013/188638). In some embodiments, the HNH motif or the RuvC motif can comprise mutations that reduce or eliminate their activity as compared to wild-type Cas9 nucleases. In some embodiments, just one motif is mutated (e.g., either the HNH motif or the RuvC motif). In other embodiments, both motifs are mutated such that both activities are reduced or eliminated. Any type of mutation including missense mutations, nonsense mutations, frameshift mutations, and the like, can be used to reduce or eliminate the activity of the HNH motif and/or the RuvC motif in a Cas9 nuclease.

The present disclosure identifies several CRISPR-Cas systems and groupings of Cas9 nucleases. These groupings include a *Streptococcus thermophilus* CRISPR 1 (Sth CR1) group of Cas9 nucleases, a *Streptococcus thermophilus* CRISPR 3 (Sth CR3) group of Cas9 nucleases, a *Lactobacillus buchneri* CD034 (Lb) group of Cas9 nucleases, and a *Lactobacillus rhamnosus* GG (Lrh) group of Cas9 nucleases. Non-limiting examples of Sth CR1 group Cas9 nucleases include the Cas9 nucleases encoded by the polypeptide sequences of SEQ ID NOs:1-9 and 51. Non-limiting examples of Sth CR3 group Cas9 nucleases include the Cas9 nucleases encoded by the polypeptide sequences of SEQ ID NOs:10-23. Non-limiting examples of Lb group Cas9 nucleases include the Cas9 nucleases encoded by the polypeptide sequences of SEQ ID NOs:28, 30-33, 35, 43, 44, 47, 50 and 52. Non-limiting examples of Lrh group Cas9 nucleases include the Cas9 nucleases encoded by the polypeptide sequences of SEQ ID NOs:24-27, 29, 34, 36-42, 45 and 53. Additional Cas9 nucleases include, but are not limited to, those of *Lactobacillus curvatus* CRL 705. Still further Cas9 nucleases useful with this invention include, but are not limited to, a Cas9 from *Lactobacillus animalis* KCTC 3501, and *Lactobacillus farciminis* WP 010018949.1.

Thus, in some embodiments, the Cas9 nuclease may comprise, consist essentially of, or consist of a Cas9 from a *Streptococcus thermophilus* CRISPR 1 (Sth CR1) group of Cas9 nucleases, a Cas9 from *Streptococcus thermophilus* CRISPR 3 (Sth CR3) group of Cas9 nucleases, a Cas9 nuclease from a *Lactobacillus buchneri* CD034 (Lb) group of Cas9 nucleases, and/or a Cas9 nuclease from a *Lactobacillus rhamnosus* GG (Lrh) group of Cas9 nucleases. In further embodiments, an amino acid sequence encoding a Cas9 nuclease can be an amino acid sequence of any one of SEQ ID NO:1 to SEQ ID NO:53. In still further embodiments, a Cas9 nuclease useful with a synthetic tracr nucleic acid construct, a synthetic CRISPR nucleic acid construct, a synthetic CRISPR nucleic acid array, and/or a chimeric nucleic acid construct of this disclosure comprises, consists essentially of, or consists of a nucleotide sequence encoding an amino acid sequence having at least 70% identity to an amino acid sequence of any one of SEQ ID NO:1 to SEQ ID NO:53.

Furthermore, in particular embodiments, the Cas9 nuclease can be encoded by a nucleotide sequence that is codon optimized for an organism comprising the target DNA. In still other embodiments, the Cas9 nuclease can comprise at least one nuclear localization sequence.

The present inventors have surprisingly discovered a functional pairing between the nexus sequence of a synthetic tracr nucleic acid construct (tracrRNA, tracrDNA) with particular groups of Cas9 nucleases. Thus, in some embodiments, when the nexus sequence is GATAAGGC or GATAAGGCCATGCC (SEQ ID NO:75), the Cas9 nuclease is from a *Streptococcus thermophilus* CRISPR 1 (STh CR1) group of Cas9 nucleases; when the nexus sequence is TAAGGC or TAAGGCTAGTCC (SEQ ID NO:76), the Cas9 nuclease is from a *Streptococcus thermophilus* CRISPR 3 (Sth CR3) group of Cas9 nucleases; when the nexus sequence is TCAAGC or TCAAGCAAAGC (SEQ ID NO:77), the Cas9 nuclease is from a *Lactobacillus buchneri* CD034 (Lb) group of Cas9 nucleases; or when the nexus sequence is TCAAAC or TCAAACAAAGCTTCAGC (SEQ ID NO:78) and the Cas9 nuclease is from a *Lactobacillus rhamnosus* GG (Lrh) group of Cas9 nucleases.

As described herein, a Cas9 nuclease useful with this invention can comprise a mutation in a HNH motif and/or a RuvC motif, thereby reducing or eliminating the activity of the respective motif. As known in the art, a mutation in the HNH motif reduces/eliminates site-specific nicking of the (+) strand a double stranded target DNA and a mutation in the RucV active site reduces/eliminates site-specific nicking of the (−) strand of the double stranded target DNA. A mutation in both active sites reduces/eliminates cleavage of the DNA (i.e., reduces/eliminates site-specific cleavage of the target DNA). Therefore, in some embodiments, a synthetic tracr nucleic acid construct, a synthetic CRISPR nucleic acid construct, a CRISPR nucleic acid array, and/or a chimeric nucleic acid construct of this disclosure comprises a Cas9 nuclease having a mutation in the RuvC active site motif. In other embodiments, a synthetic tracr nucleic acid construct, a synthetic CRISPR nucleic acid construct, a CRISPR nucleic acid array, and/or a chimeric nucleic acid construct of this disclosure comprises a Cas9 nuclease having a mutation in the HNH active site motif. In still further embodiments, a synthetic tracr nucleic acid construct, a synthetic CRISPR nucleic acid construct, a CRISPR nucleic acid array, and/or a chimeric nucleic acid construct of this disclosure comprises a Cas9 nuclease having a mutation in the HNH active site motif and in the RuvC motif.

In still further embodiments, a Cas9 nuclease having a mutation in the HNH and RuvC motifs, thereby having reduced or eliminated nuclease activity, further comprises a polypeptide of interest fused to the Cas9 nuclease. Such a Cas9-polypeptide of interest fusion protein can be used to direct or target the polypeptide of interest to a particular target DNA.

Further provided herein are methods for using the synthetic tracr nucleic acid constructs, the synthetic CRISPR nucleic acid constructs, the CRISPR nucleic acid arrays, and/or the chimeric nucleic acid constructs of this disclosure. Thus, in some embodiments, a method for site-specific cleavage of a double stranded target DNA is provided, comprising: contacting a chimeric nucleic acid construct of this disclosure or an expression cassette comprising a chimeric nucleic acid construct of this disclosure with the target DNA in the presence of a Cas9 nuclease (e.g., SEQ ID NOs:1-53), thereby producing a site-specific cleavage of the target DNA in a region defined by complementary hybridization of the spacer sequence to the target DNA. In some embodiments, the site-specific cleavage can be a site-specific nicking of a (+) strand of the double stranded target DNA and said Cas9 nuclease comprises a mutation in a RuvC active site motif, thereby cleaving the (+) strand of the double stranded target and producing a site-specific nick in said (+) strand the double stranded target DNA. In other embodiments, the site-specific cleavage is a site-specific nicking of the (−) strand of the double stranded target DNA and said Cas9 nuclease comprises a point mutation in a HNH active site motif, thereby cleaving the (−) strand of the double stranded target DNA and producing a site-specific nick in said (−) strand the double stranded target DNA.

In additional embodiments, a method for site-specific cleavage of a double stranded target DNA is provided, comprising: contacting a trans-encoded CRISPR (tracr) nucleic acid molecule and a CRISPR nucleic acid molecule with the target DNA in the presence of a Cas9 nuclease (e.g., SEQ ID NOs:1-53), wherein (a) the tracr nucleic acid molecule is encoded by a nucleotide sequence comprising from 5' to 3', an anti-zipper sequence comprising at least about 3 nucleotides; a bulge sequence comprising at least about three nucleotides; an anti-stitch sequence comprising a nucleotide sequence of NNANN; a nexus sequence comprising a nucleotide sequence of TNANNC, T(A/C)A(A/G) (G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence comprising, consisting essentially of, or consisting of at least one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and (b) the CRISPR nucleic acid molecule is encoded by a nucleotide sequence comprising from 3' to 5', a zipper sequence comprising at least about 3 nucleotides, a bulge sequence comprising a nucleotide sequence having at least two nucleotides, a stitch sequence comprising a nucleotide sequence of NNTNN (or NNUNN), a $G_{R1}$ comprising a nucleotide G or GTT, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence, and further wherein the anti-zipper sequence and anti-stitch sequence of the tracr nucleic acid molecule are at least about 70% complementary to and hybridize to the zipper sequence and the stitch sequence of the CRISPR nucleic acid molecule, respectively, and the spacer sequence of the CRISPR nucleic acid molecule is at least about 80% complementary to and hybridizes to a portion of the target DNA and adjacent to a protospacer adjacent motif (PAM) on the target DNA, thereby resulting in a site-specific cleavage of the target DNA in a region defined by the complementary binding of the spacer sequence of the CRISPR nucleic acid molecule to the target DNA.

In other embodiments, a method for site-specific cleavage of a double stranded target DNA is provided, comprising: contacting the double stranded target DNA with a chimeric nucleic acid comprising, (a) a first nucleotide sequence comprising from 5' to 3', an anti-zipper sequence comprising at least about 9 nucleotides; a bulge sequence comprising at least about 4 nucleotides; an anti-stitch sequence comprising a nucleotide sequence of NNANN; a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at least one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; (b) a second nucleotide sequence comprising from 3' to 5', a zipper sequence comprising at least about 3 nucleotides, a bulge sequence that comprises a nucleotide sequence having at least two nucleotides, a stitch sequence comprising a nucleotide sequence of NNTNN (or NNUNN), a $G_{R1}$ comprising a nucleotide G or GTT, and a spacer sequence having a 5' end and a 3' end and comprising at least seven nucleotides at its 3' end that have 100% identity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence; and (c) a third nucleotide sequence encoding an amino acid sequence having at least 80% identity to an amino acid sequence encoding a Cas9 nuclease (e.g., SEQ ID NOs:1-53), wherein the anti-zipper sequence and the anti-stitch sequence of the first nucleotide sequence hybridize to the zipper sequence and stitch sequence of the second nucleotide sequence and the spacer sequence of the second nucleotide sequence hybridizes to a portion of the target DNA and adjacent to a protospacer adjacent motif (PAM) on the target DNA, thereby resulting in a site-specific cleavage of the target DNA in a region defined by the complementary binding of the spacer sequence of the second nucleotide sequence to the target DNA In a further embodiment, a method of site-specific targeting of a polypeptide of interest to a double stranded (ds) target DNA is provided, comprising contacting a trans-encoded CRISPR (tracr) nucleic acid molecule and a CRISPR nucleic acid molecule with the target DNA in the presence of a Cas9 nuclease (e.g., SEQ ID NOs:1-53), wherein (a) the tracr nucleic acid molecule is encoded by a nucleotide sequence comprising from 5' to 3', an anti-zipper sequence comprising at least about 3 nucleotides; a bulge sequence comprising at least about three nucleotides; an anti-stitch sequence comprising a nucleotide sequence of NNANN; a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78); and a hairpin sequence comprising a nucleotide sequence having at one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and (b) the CRISPR nucleic acid molecule is encoded by a nucleotide sequence comprising from 3' to 5', a zipper sequence comprising at least about 3 nucleotides, a bulge sequence comprising at least two nucleotides (e.g., the nucleotide sequence of (—NN—)), a stitch sequence comprising a nucleotide sequence of NNTNN, a $G_{R1}$ comprising a nucleotide G or GTT, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the $G_{R1}$, and the $G_{R1}$ is located immediately upstream of the spacer sequence, and further wherein the Cas9 nuclease comprises a mutation in a HNH active site motif, a mutation in a RuvC active site motif, and is fused to a polypeptide of interest, the anti-zipper sequence is about 70% complementary to and hybridizes to the zipper sequence, the stitch sequence is 100% complementary to and hybridizes to the stitch sequence, and the spacer sequence is about 80% complementary to and hybridizes to the target DNA adjacent to a protospacer adjacent motif (PAM) on the target DNA, thereby resulting in a site-specific targeting of the polypeptide of interest to the target DNA in a region defined by the complementary binding of the spacer sequence of the CRISPR nucleic acid molecule to the target DNA.

In representative embodiments, as described herein for a synthetic tracr nucleic acid construct, the bulge sequence of a synthetic tracr nucleic acid molecule or a first nucleotide sequence can comprise, consist essentially of, or consist of about three, four or five nucleotides. In other embodiments, the bulge sequence can comprises, consists essentially of or consists of five nucleotides, and the hairpin sequence can comprise, consist essentially of or consist of at least two hairpins, wherein each hairpin comprises at least three matched base pairs.

In further embodiments, the present invention provides a method for site-specific cleavage of a double stranded target DNA, comprising: contacting a trans-encoded CRISPR (tracr) nucleic acid molecule and a CRISPR nucleic acid molecule with the target DNA in the presence of a Cas9 nuclease, wherein (a) the tracr nucleic acid molecule is encoded by a nucleotide sequence comprising from 5' to 3', an anti-zipper sequence comprising at least about three nucleotides; a bulge sequence comprising at least about three nucleotides; an anti-stitch sequence comprising a nucleotide sequence of NNANN, a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78) a hairpin sequence comprising a nucleotide sequence having at least one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and (b) the CRISPR nucleic acid molecule is encoded by a nucleotide sequence comprising from 3' to 5', a zipper sequence comprising a nucleotide sequence having at least three nucleotides that hybridize to the anti-zipper, a bulge sequence that comprises the nucleotide sequence of (—NN—), a stitch sequence comprising a nucleotide sequence of NNUNN, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the spacer sequence, and further wherein, when the anti-zipper and zipper sequences are present, the anti-zipper sequence hybridizes to the zipper sequence, the NNANN of anti-stitch sequence is complementary to and hybridizes to the NNUNN of the stitch sequence, and the spacer sequence of the CRISPR nucleic acid molecule hybridizes to a portion of the target DNA and adjacent to a protospacer adjacent motif (PAM) on the target DNA, thereby resulting in a site-specific cleavage of the target DNA in a region defined by the hybridization of the spacer sequence of the CRISPR nucleic acid molecule to the target DNA.

In still further embodiments, a method for site-specific cleavage of a double stranded target DNA is provided, the method comprising: contacting the double stranded target DNA with a chimeric nucleic acid comprising, (a) a first nucleotide sequence comprising from 5' to 3', an anti-zipper sequence comprising at least about three nucleotides; a bulge sequence comprising at least about three nucleotides; an anti-stitch sequence comprising a nucleotide sequence of NNANN, a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78), a hairpin sequence comprising a nucleotide sequence having at least one hairpin, said hairpin comprising at least three matched base pairs, wherein the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence;

(b) a second nucleotide sequence comprising from 3' to 5', a zipper sequence comprising a nucleotide sequence having at least three nucleotides that hybridize to the anti-zipper, a bulge sequence comprising a nucleotide sequence having at least two nucleotides (e.g., the nucleotide sequence of (—NN—)), a stitch sequence comprising a nucleotide sequence of NNUNN, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the spacer sequence; and (c) a third nucleotide sequence encoding an amino acid sequence having at least 80% identity to an amino acid sequence encoding a Cas9 nuclease (e.g., SEQ ID NOs:1-53), wherein, when the zipper sequence and anti-zipper sequence are present, the zipper sequence hybridizes to the anti-zipper sequence, the NNANN of anti-stitch sequence is complementary to and hybridizes to the NNUNN of the stitch sequence, and the spacer sequence of the second nucleotide sequence hybridizes to a portion of the target DNA and adjacent to a protospacer adjacent motif (PAM) on the target DNA, thereby resulting in a site-specific cleavage of the target DNA in a region defined by the hybridization of the spacer sequence of the second nucleotide sequence to the target DNA.

In additional embodiments, a method of site-specific targeting of a polypeptide of interest to a double stranded (ds) target DNA is provided, comprising contacting a trans-encoded CRISPR (tracr) nucleic acid molecule and a CRISPR nucleic acid molecule with the target DNA in the presence of a Cas9 nuclease (e.g., SEQ ID NOs:1-53), wherein (a) the tracr nucleic acid molecule is encoded by a nucleotide sequence comprising from 5' to 3', an anti-zipper sequence comprising at least about three nucleotides; a bulge sequence comprising at least about three nucleotides; an anti-stitch sequence comprising a nucleotide sequence of NNANN, a nexus sequence comprising a nucleotide sequence of TNANNC, T(A/C)A(A/G)(G/A)C, TCAAAC, TAAGGC, GATAAGG, GATAAGGCTT (SEQ ID NO:74), TCAAG, TCAAGCAA, T(C/A)AA(A/C)(C/A)(A/G)(A/T), GATAAGGCCATGCC (SEQ ID NO:75), TAAGGCTAGTCC (SEQ ID NO:76), TCAAGCAAAGC (SEQ ID NO:77), or TCAAACAAAGCTTCAGC (SEQ ID NO:78), a hairpin sequence comprising a nucleotide sequence having at least one hairpin, said hairpin comprising at least three matched base pairs, and the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and (b) the CRISPR nucleic acid molecule is encoded by a nucleotide sequence comprising from 3' to 5', a zipper sequence comprising a nucleotide sequence having at least three nucleotides that hybridize to the anti-zipper, a bulge sequence comprising a nucleotide sequence having at least two nucleotides (e.g., the nucleotide sequence of (—NN—)), a stitch sequence comprising a nucleotide sequence of NNUNN, and a spacer sequence having a 5' end and a 3' end and comprising at least seven nucleotides at its 3' end having 100% identity to a target DNA, and the zipper sequence is located immediately upstream of the bulge sequence, the bulge sequence is located immediately upstream of the stitch sequence, the stitch sequence is located immediately upstream of the spacer sequence, and further wherein the Cas9 nuclease comprises a mutation in a HNH active site motif, a mutation in a RuvC active site motif, and is fused to a polypeptide of interest, when the zipper sequence and anti-zipper sequence are present, the zipper sequence hybridizes to the anti-zipper sequence, the NNANN of anti-stitch sequence is complementary to and hybridizes to the NNUNN of the stitch sequence, and the spacer sequence hybridizes to the target DNA adjacent to a protospacer adjacent motif (PAM) on the target DNA, thereby resulting in a site-specific targeting of the polypeptide of interest to the target DNA in a region defined by the hybridization of the spacer sequence of the CRISPR nucleic acid molecule to the target DNA.

In some embodiments, when the anti-zipper and zipper sequences of a tracr nucleic acid molecule and a CRISPR nucleic acid molecule or a first nucleotide sequence and a second nucleotide sequence hybridize, the hybridized sequences can optionally further comprise additional nucleotides at the end of the of the hybridized sequences that is distal to the bulge sequences, thereby linking the hybridized zipper and the anti-zipper sequence. A linking nucleotide can be any nucleotide (e.g., T, A, G, C) and the number of nucleotides linking the zipper and anti-zipper sequences or the bulge sequences can be about three to about seven.

Any wild-type, mutated, codon-optimized Cas9 nuclease or those comprising at least one nuclear localization sequence as described herein can be used with the methods of the invention including but not limited to SEQ ID NOs:1-53.

Additionally provided herein are expression cassettes and vectors comprising the nucleic acid constructs, the nucleic acid arrays, nucleic acid molecules and/or the nucleotide sequences of this invention, which can be used with the methods of this disclosure.

In further aspects, the nucleic acid constructs, nucleic acid arrays, nucleic acid molecules, and/or nucleotide sequences of this invention can be introduced into a cell of a host organism. Any cell/host organism for which this invention is useful with can be used. Exemplary host organisms include, but are not limited to, a plant, bacteria, archaeon, fungus, animal, mammal, insect, bird, fish, amphibian, cnidarian, human, or non-human primate. In particular embodiments, a host organism can be, but is not limited to *Homo sapiens, Drosophila melanogaster, Mus musculus, Rattus norvegicus, Caenorhabditis elegans, Saccharomyces pombe, Saccharomyces cerevisiae, Glycine max, Zeae maydis, Gossypium hirsutum,* or *Arabidopsis thaliana.* In further embodiments, a cell useful with this invention can be, but is not limited to a stem cell, somatic cell, germ cell, plant cell, animal cell, bacterial cell, archaeon cell, fungal cell, mammalian cell, insect cell, bird cell, fish cell, amphibian cell, cnidarian cell, human cell, or non-human primate cell. In other embodiments, a cell useful with this invention includes but is not limited to a cell from *Homo sapiens, Drosophila melanogaster, Mus musculus, Rattus norvegicus, Caenorhabditis elegans, Saccharomyces pombe, Saccharomyces cerevisiae, Glycine max, Zeae maydis, Gossypium hirsutum,* or *Arabidopsis thaliana.*

In further aspects of the invention, a polypeptide of interest can include but is not limited to a helicase, a nuclease, a methyltransferase, a gyrase, a demethylase, a kinase, a dismutase, an integrase, a transposase, a telomerase, a recombinase, an acetyltransferase, a deacetylase, a polymerase, a phosphatase, a ligase, a ubiquitin ligase, a photolyase or a glycosylase. In other aspects of the invention, a polypeptide of interest comprises depurination activity, oxidation activity, pyrimidine dimer forming activity, alkylation activity, DNA repair activity, DNA damage activity, deubiquitinating activity, adenylation activity, deadenylation activity SUMOylating activity, deSUMOylating activity, ribosylation activity, deribosylation activity, myristoylation activity, demyristoylation activity or telomere repair activity, or deamination activity. In representative embodiments, a polypeptide of interest can be a polypeptide having kinase activity, nuclease activity, methyltransferase activity, demethylase activity, acetyltransferase activity, deacetylase activity, phosphatase activity, ubiquitin ligase activity, deubiquitinating activity, or telomere repair activity.

Further provided herein are kits comprising the nucleic acid constructs, nucleic acid molecules, and/or nucleotide sequences of this invention.

Thus, in one aspect, a kit for site-specific cleavage of double stranded DNA is provided, the kit comprising a synthetic tracr nucleic acid construct, a synthetic CRISPR nucleic acid construct, a CRISPR nucleic acid array or a chimeric nucleic acid construct of this invention. In another aspect, a kit for site-specific targeting of a polypeptide of interest to a double stranded (ds) target DNA is provided, the kit comprising a synthetic tracr nucleic acid construct, a synthetic CRISPR nucleic acid construct, a CRISPR nucleic acid array or a chimeric nucleic acid construct of this invention. In some aspects, the kit can comprise the synthetic tracr nucleic acid construct, the synthetic CRISPR nucleic acid construct, the CRISPR nucleic acid array and/or the chimeric nucleic acid construct of this invention comprised in one or more expression cassettes. In still further aspects, a kit can further comprise a Cas9 nuclease (e.g., SEQ ID NOs:1-53) for use with the nucleic acid constructs, nucleic acid arrays, nucleic acid molecules, and/or nucleotide sequences of this invention described herein.

In further aspects, a kit can comprise primers said primers comprising portions of CRISPR repeat sequences in both directions. In other embodiments, a kit can comprise primers designed to comprise the boundaries of a CRISPR array (namely the leader end on one side, and the trailer end on the other), and extend through the CRISPR repeat sequence in both directions.

In additional embodiments, a kit can further comprise instructions for use.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1. Assessing the Functional Role of Modules Identified in the Guide Sequences Clustered regularly interspaced short palindromic repeats (CRISPR) and associated Cas proteins provide adaptive immunity against invasive genetic elements in bacteria and archaea[1]. In Type II CRISPR-Cas systems, the signature RNA-guided endonuclease Cas9 specifically targets sequences complementary to CRISPR spacers and generates double-stranded DNA breaks (DSBs) using two nickase domains (Makarova, K. S. et al. *Nat Rev Microbiol* 9, 467-477 (2011); Garneau, J. E. et al. *Nature* 468, 67-71 (2010); Sapranauskas, R. et al. *Nucleic Acids Res* 39, 9275-9282 (2011); Gasiunas, G. et al. *Proc Natl Acad Sci* USA 109, E2579-E2586 (2012); Jinek, M. et al., *Science* 337, 816-821 (2012)). Any DNA sequence may be targeted, as long as it is flanked by a Cas9-specific protospacer-adjacent motif (PAM) Garneau, J. E. et al. *Nature* 468, 67-71 (2010); Sapranauskas, R. et al. *Nucleic Acids Res* 39, 9275-9282 (2011); Gasiunas, G. et al. *Proc Natl Acad Sci USA* 109, E2579-E2586 (2012); Jinek, M. et al., *Science* 337, 816-821 (2012); Stenberg, S. H. et al. *Nature* 507, 62 (2014)). Targeting and cleavage by Cas9 systems rely on a RNA duplex consisting of CRISPR RNA (crRNA) and a trans-activating crRNA (tracrRNA)[8]. This native complex can be replaced by a synthetic single guide RNA (sgRNA) chimera which mimics the crRNA:tracrRNA duplex (Jinek, M. et al., *Science* 337, 816-821 (2012)). sgRNAs in combination with Cas9 make convenient, compact, and portable sequence-specific targeting systems that are amenable to engineering and heterologous transfer into a variety of model systems of industrial and translational interest.

Accordingly, the Cas9:sgRNA technology, which provides a compact and practical means to generate double strand breaks (DSBs), has revolutionized genome editing (Mali, P. et al., *Science* 339, 823-826 (2013); Cong, L. et al. *Science* 339, 819-823 (2013); Jiang, W. et al. *Nat. Biotechnol.* 31, 233-239 (2013); Sander, J. D. & Joung, J. K. *Nature Biotechnol.* 32, 347-355. (2014)), opened new avenues for high-throughput genome-wide genetic screens[13][14], and expanded the toolbox for transcriptional control (Qi, L. S. et al. *Cell* 152, 1173-1183 (2013); Gilbert, L. A. et al. *Cell* 154, 442-451 (2013)). Furthermore, the absence of cross-inter-actions between evolutionarily distant Cas9:sgRNAs (Chy-linski, K. et al. *RNA biology* 10, 726-737 (2013); Fonfara, I. et al. *Nucleic Acids Res* (2013); Esvelt, K. M. et al. *Nature Methods* (2013)) has allowed multiple, independent target-ing to be achieved within a cell when co-existing functional Type II CRISPR-Cas systems function concurrently (Barr-angou, R. et al. *Science* 315, 1709-1712 (2007); Horvath, P. et al. *J Bacteriol.* 190, 1401-1412 (2008)). Despite the widespread use of these molecular machines, the critical features of sgRNA guides, and their involvement in defining functionally orthologous Cas9 endonucleases remain to be characterized. Indeed, early attention on Cas9 targeting and cleavage focused on spacer:target complementarity and PAM sequence sensitivity, whereas there remains a paucity of information defining the elements that drive Cas9:sgRNA interactions and that dictate orthogonality between Type II CRISPR-Cas systems. Therefore, we set out to identify and characterize features within sgRNAs that impart Cas9 tar-geting and cleavage specificity to open new engineering avenues for CRISPR technologies.

Thus, to assess the functional role and implication of the various modules identified in the guides sequences discussed herein (e.g., synthetic tracr nucleic acid constructs, synthetic CRISPR nucleic acid constructs, chimeric nucleic acid con-structs (tracr nucleic acid-synthetic CRISPR nucleic acid constructs), we designed mutated variants of guides con-taining modifications or deletions of each of the aforemen-tioned functional modules. We selected the SthCRISPR3 system as a representative functional model, and first estab-lished a positive functional control (Wild Type, WT) using the native guide sequence. We then tested a "stitch" variant in which the stitch is missing, and observed loss of function. The then tested a "bulge" variant in which the bulge is missing and observed loss of function. We then tested a "nexus" variant in which the nexus is missing and observed loss of function. We then tested a "hairpin" variant in which the first hairpin is missing and observed loss of function. Subsequently, we tested sequence specificity and variability sensitivity and established in mutated constructs that the sequence of the nexus is specific, whereas there is variability tolerance for other functional modules, notably the zipper, bulge, hairpin and stitch. The results of these experiments are provided in FIGS. 1-21.

Figure 3A:
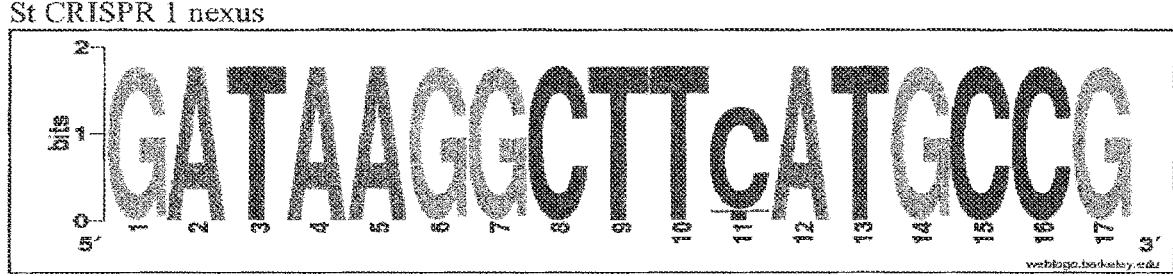
FIG. 3A-3D show consensus sequences for the nexus module.
Figure 3B:
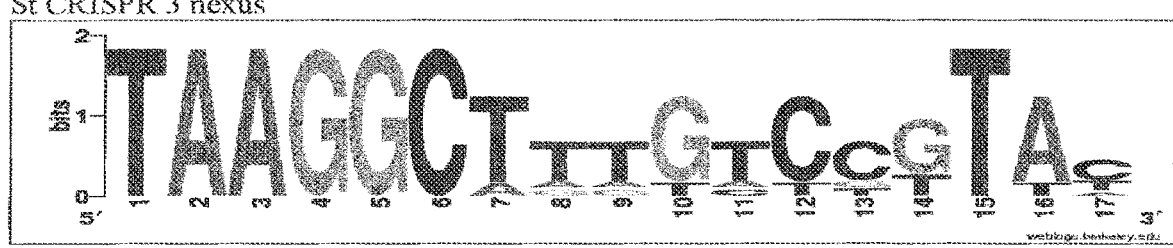
Figure 3C:
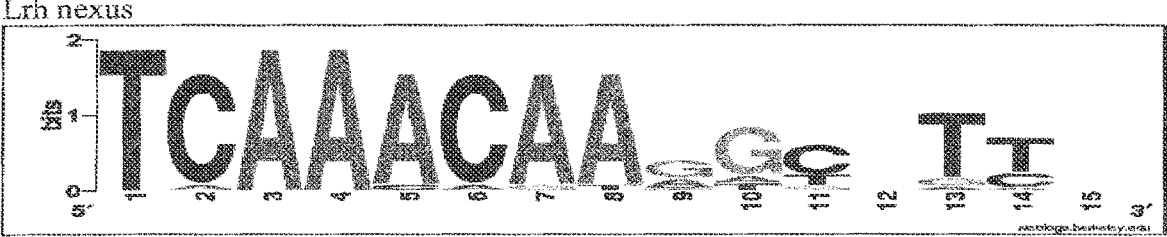
Figure 3D:
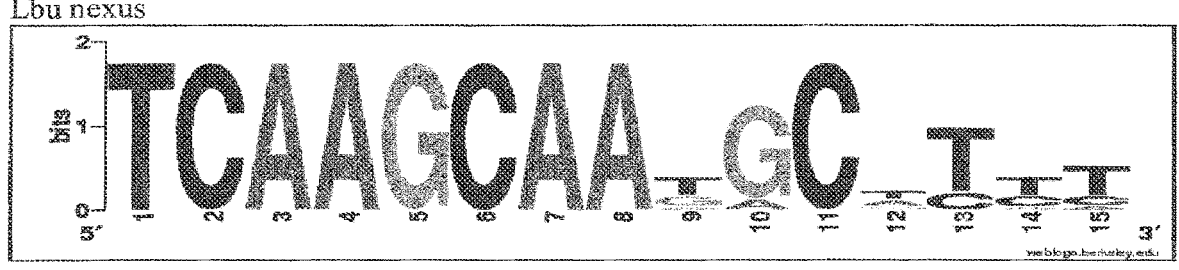

Thus, FIG. 1 shows a multiple sequence alignment for the nexus module and FIG. 2 provides a maximum likelihood tree for the nexus module developed through this research. FIG. 3A-3D show consensus sequences for the nexus mod-ule for the Sth Crl group (FIG. 3A) the Sth Cr3 group (FIG. 3B), for the Lrh group FIG. 3C and for the Lbu group (FIG. 3D).

Figure 6A:
FIG. 6A-6D show consensus sequences for the anti-stitch module.
Figure 6B:
Figure 6C:
Figure 6D:
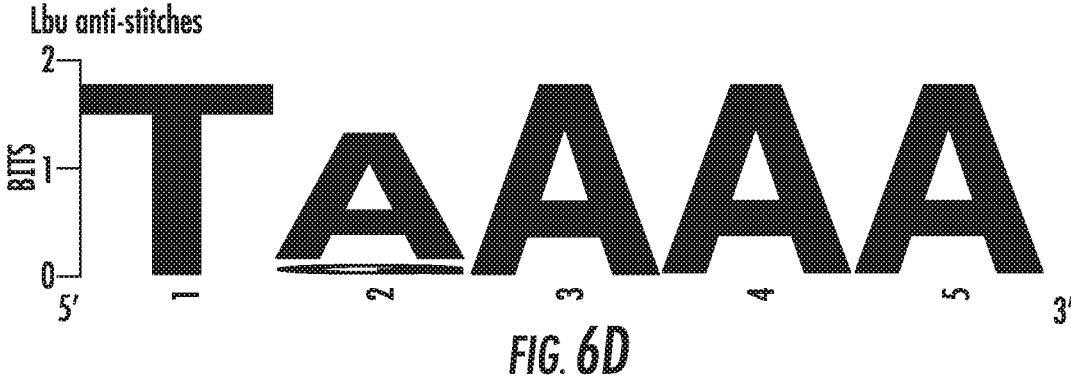

FIG. 5 shows a multiple sequence alignment for the anti-stitch module, while FIG. 6A-6D show consensus sequences for the anti-stitch module for the Sth Crl group (FIG. 6A), for the Sth Cr3 group (FIG. 6B), for the Lrh group (FIG. 6C) and for the Lbu group (FIG. 6D).

Figure 8A:
FIG. 8A-8D show consensus sequences for the bulge module.
Figure 8B:
Figure 8C:
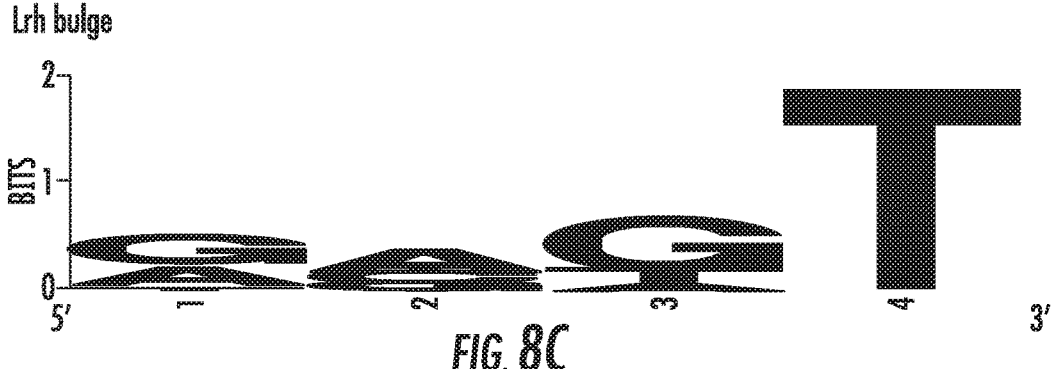
Figure 8D:
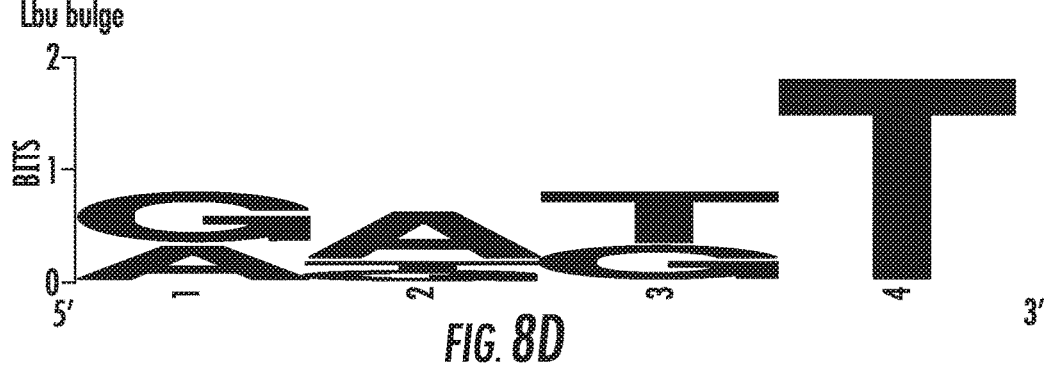

Similarly, a multiple sequence alignment for the bulge module is provided in FIG. 7 with the consensus sequences for the bulge module for the for the Sth Crl group is shown in FIG. 8A. FIG. 8B shows the consensus sequence for the bulge module for the Sth Cr3 group. FIG. 8C shows the consensus sequence for the Lrh group and FIG. 8D shows the consensus sequence for bulge module for the Lbu group.

Figure 10:
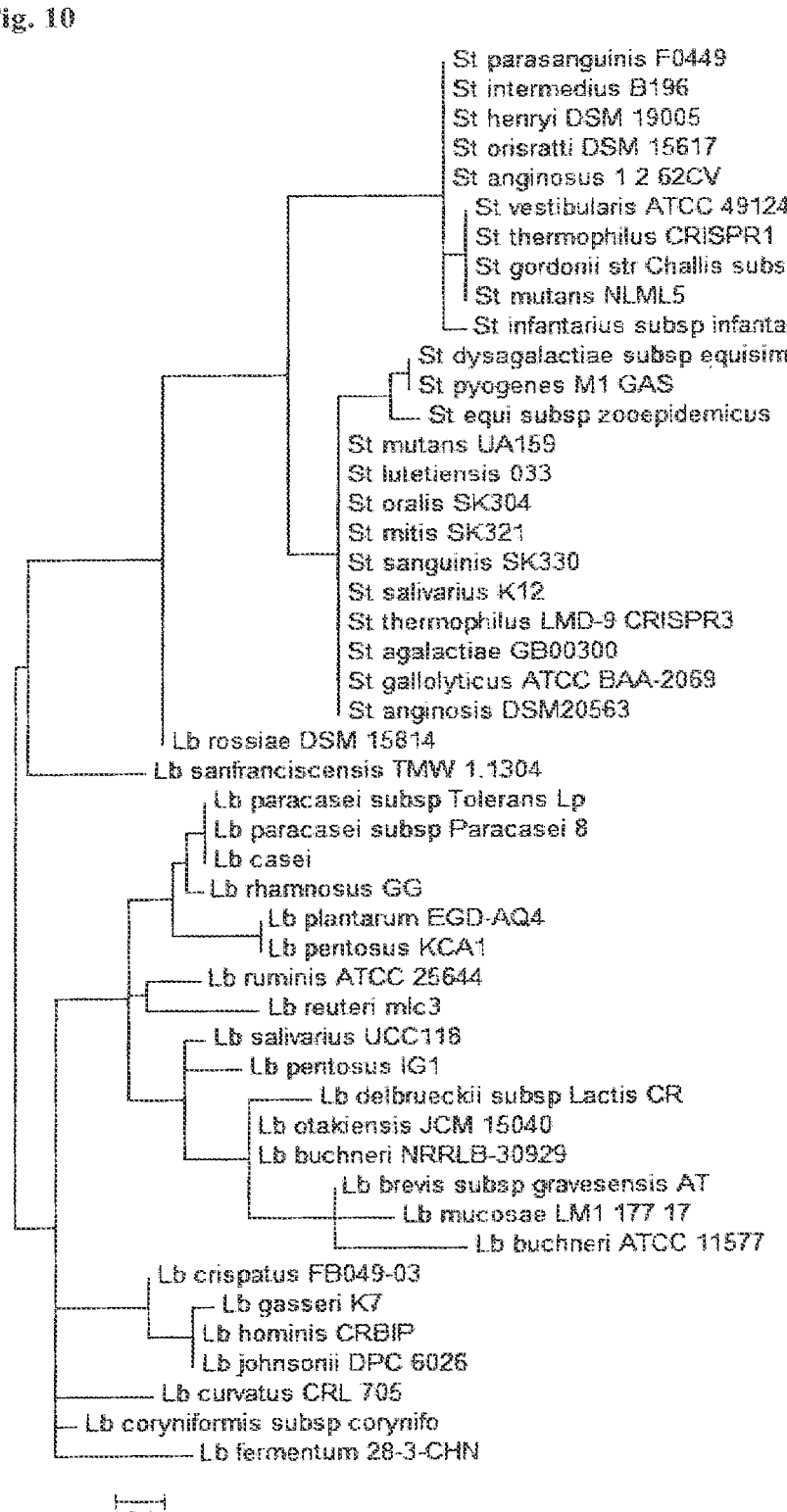
FIG. 10 shows a maximum likelihood tree for the zipper module.
Figure 12:
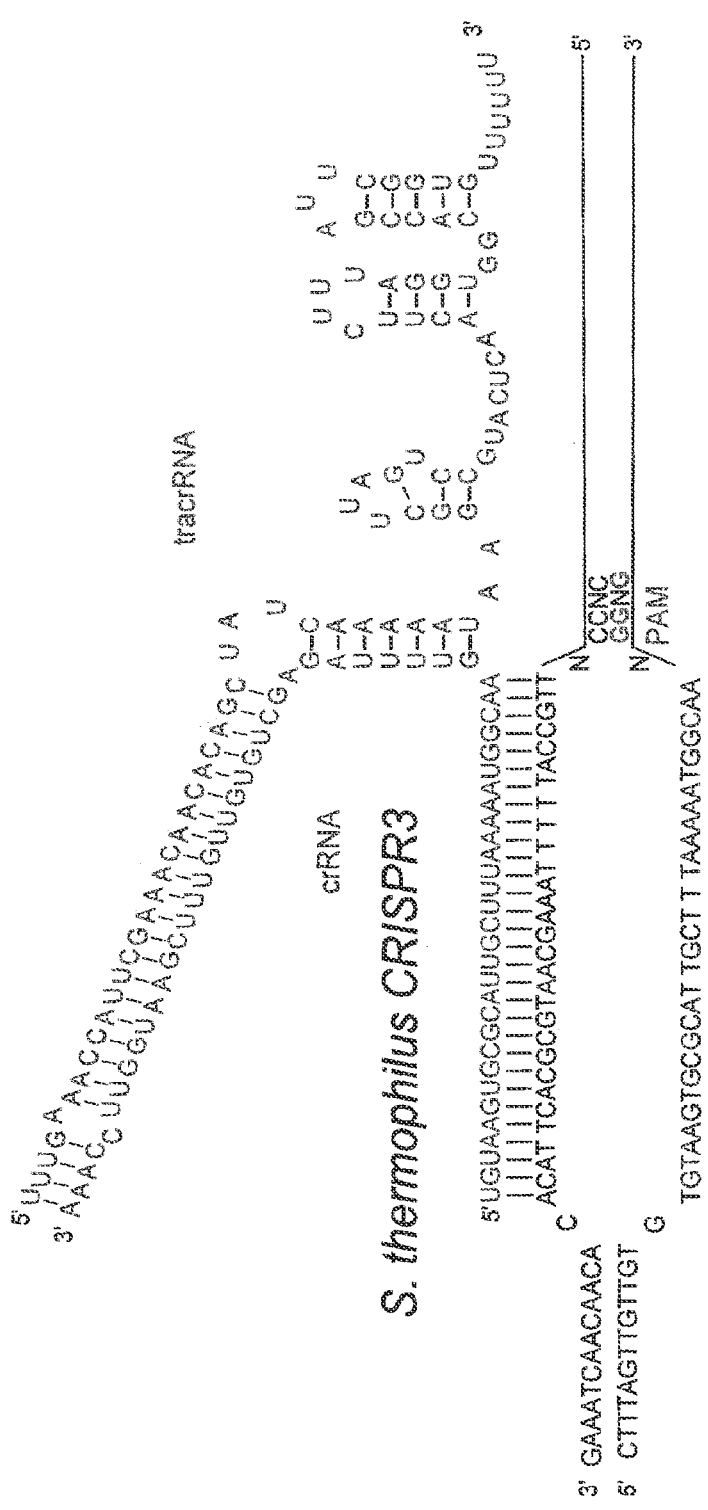
FIG. 12 shows sequence and structural details for CRISPR-Cas system elements for *Streptococcus thermophilus* CR3, representing the Sth CR1 group (SEQ ID NOs:55 and 137-139).
Figure 13:
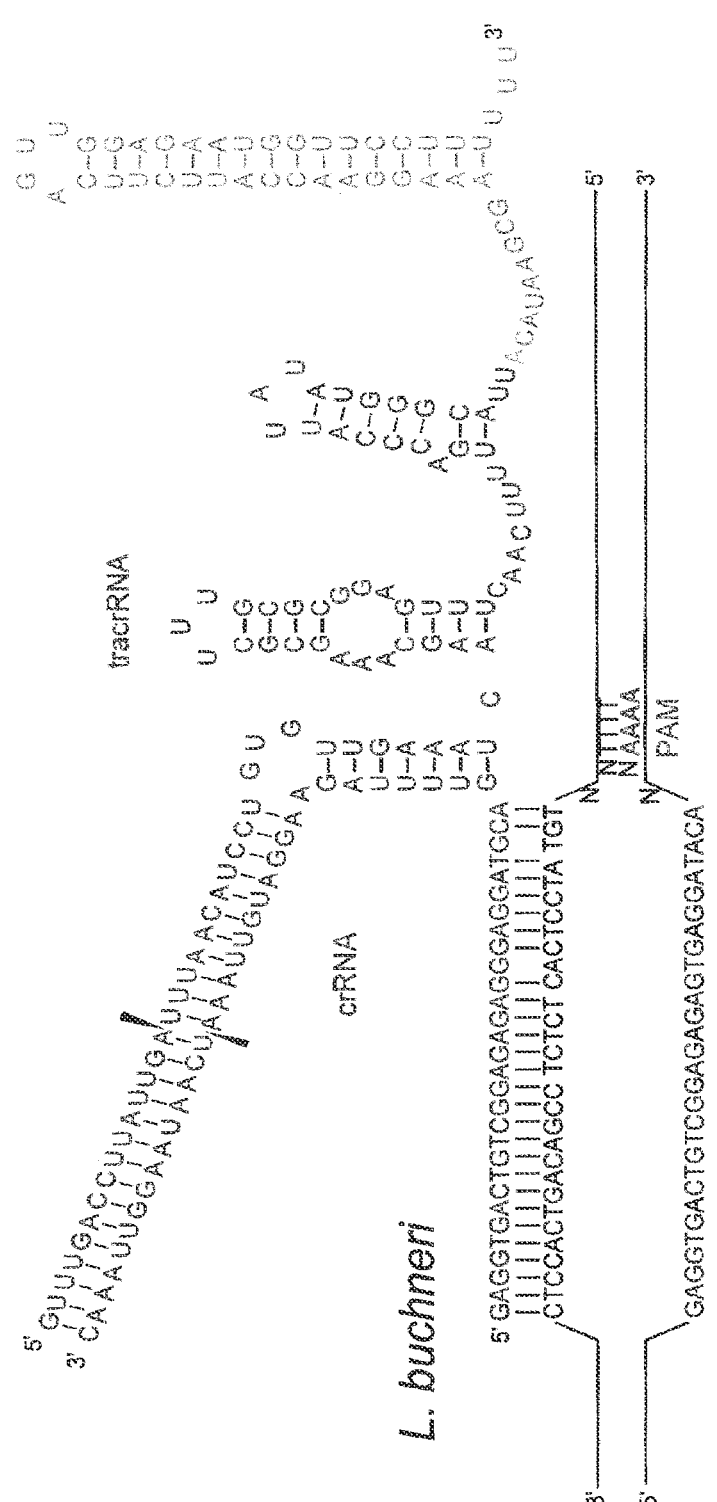
FIG. 13 shows sequence and structural details for CRISPR-Cas system elements for *Lactobacillus buchneri*, representing the Lbu group (SEQ ID NOs:140-143).
Figure 14:
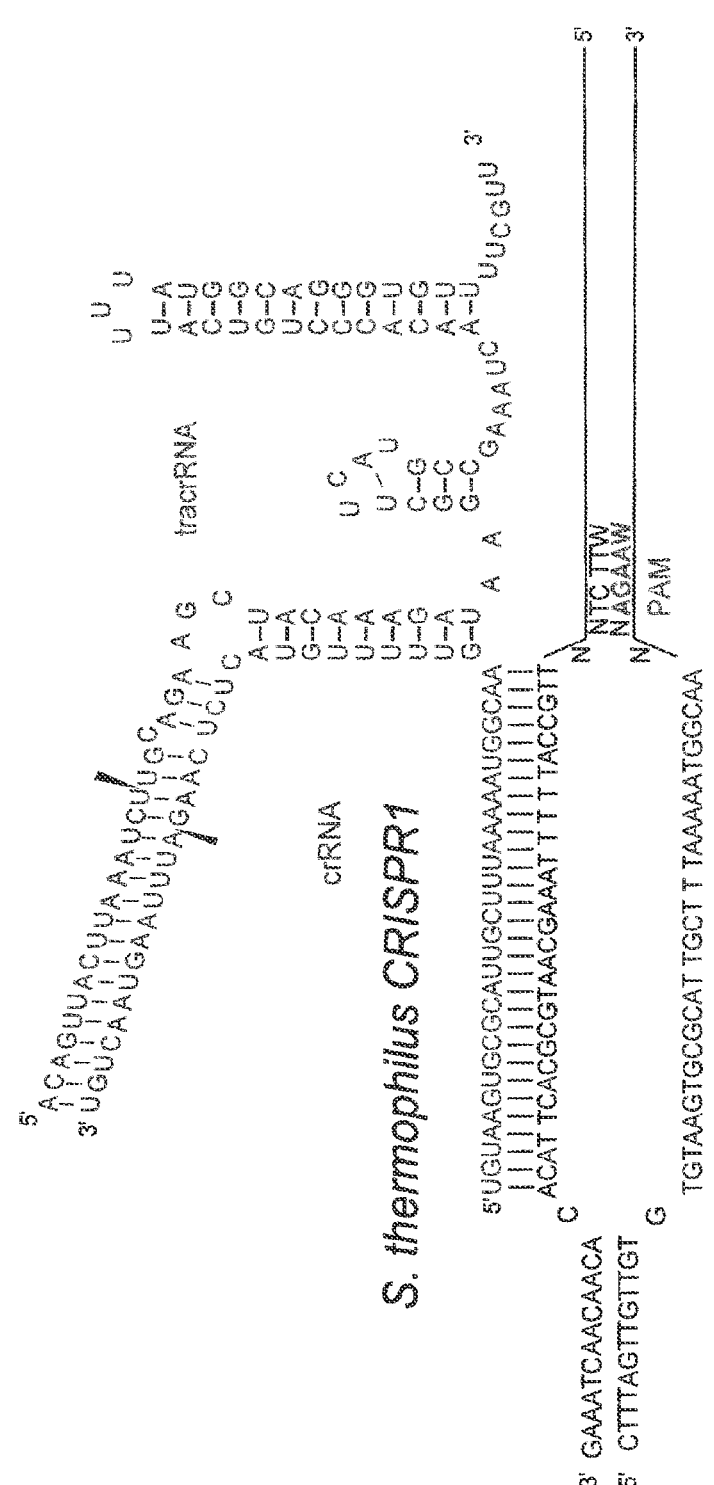
FIG. 14 shows sequence and structural details for CRISPR-Cas system elements for *Streptococcus thermophilus* CR1, representing the Sth CR1 group (SEQ ID NOs:59 and 144-146).
Figure 15:
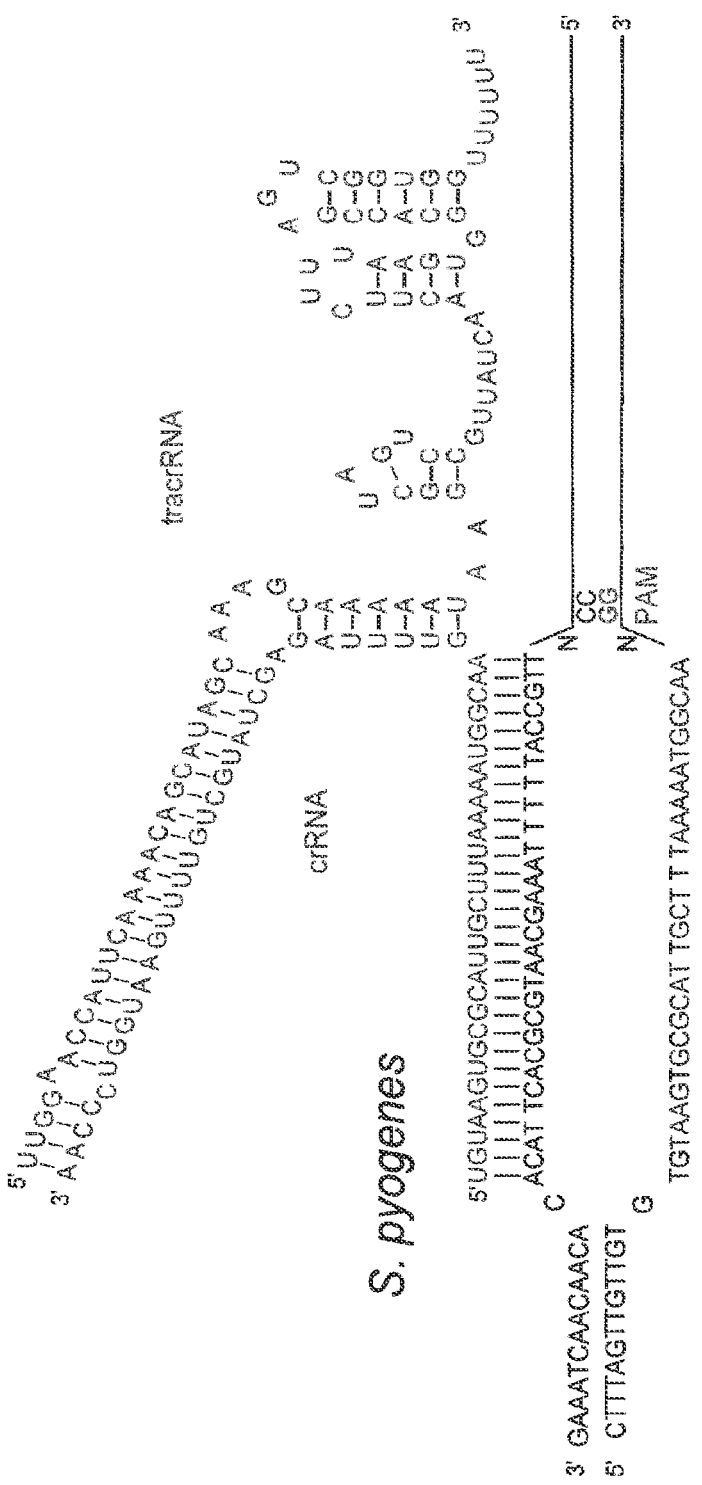
FIG. 15 shows sequence and structural details for CRISPR-Cas system elements for the *Streptococcus* pyrogenes M1 GAS, representing the Sth CR3 group (SEQ ID NOs:61 and 147-149).
Figure 16:
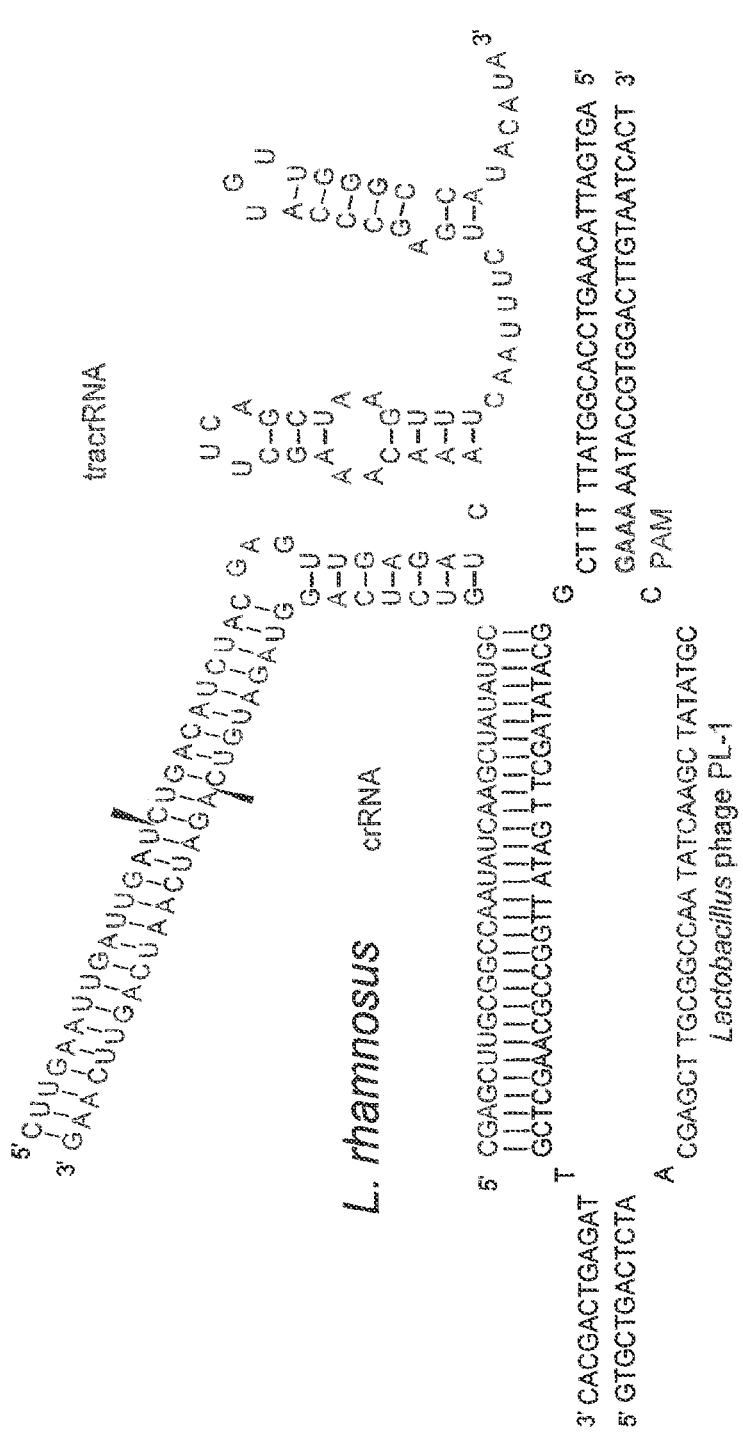
FIG. 16 shows sequence and structural details for CRISPR-Cas system elements for the *Lactobacillus rhamnosus*, representing the Lrh group (SEQ ID NOs:150-153).
Figure 17:
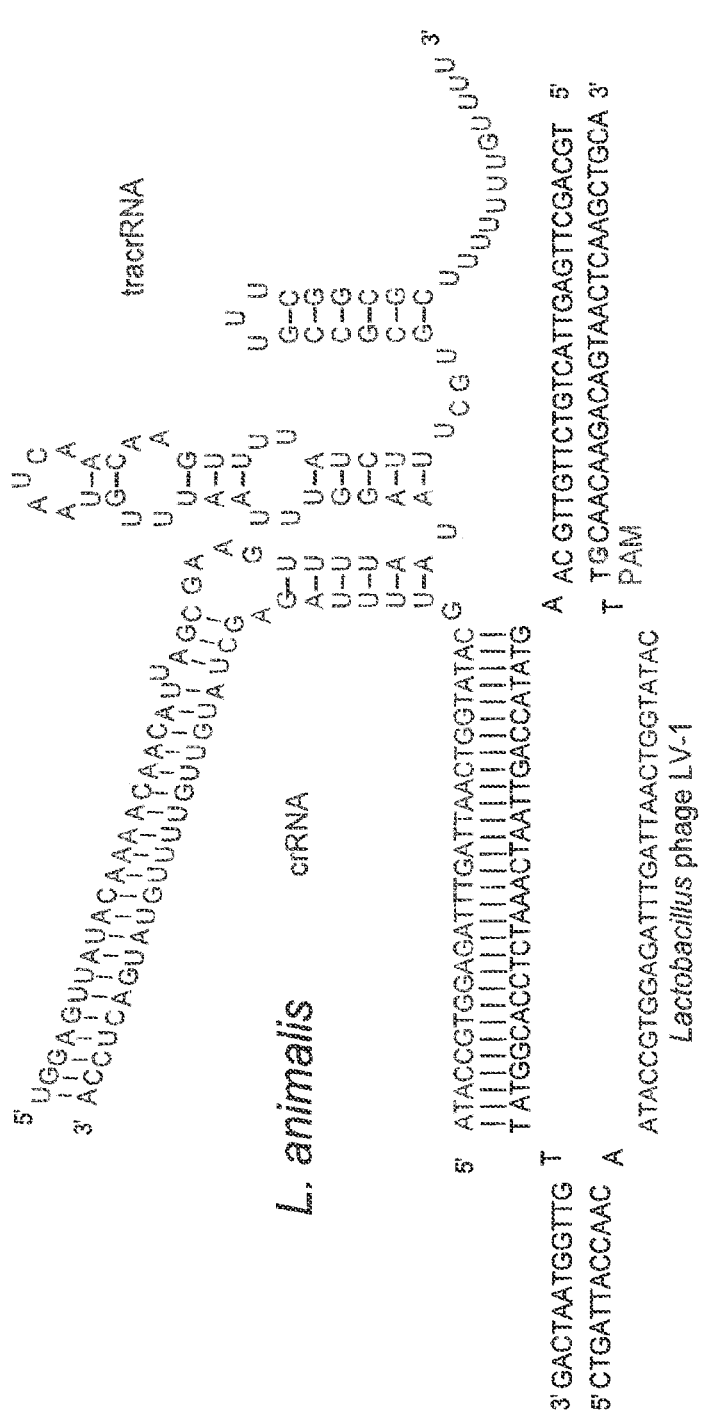
FIG. 17 shows sequence and structural details for CRISPR-Cas system elements for the *Lactobacillus animalis*, representing the Lan group (SEQ ID NOs:154-157).
Figure 18:
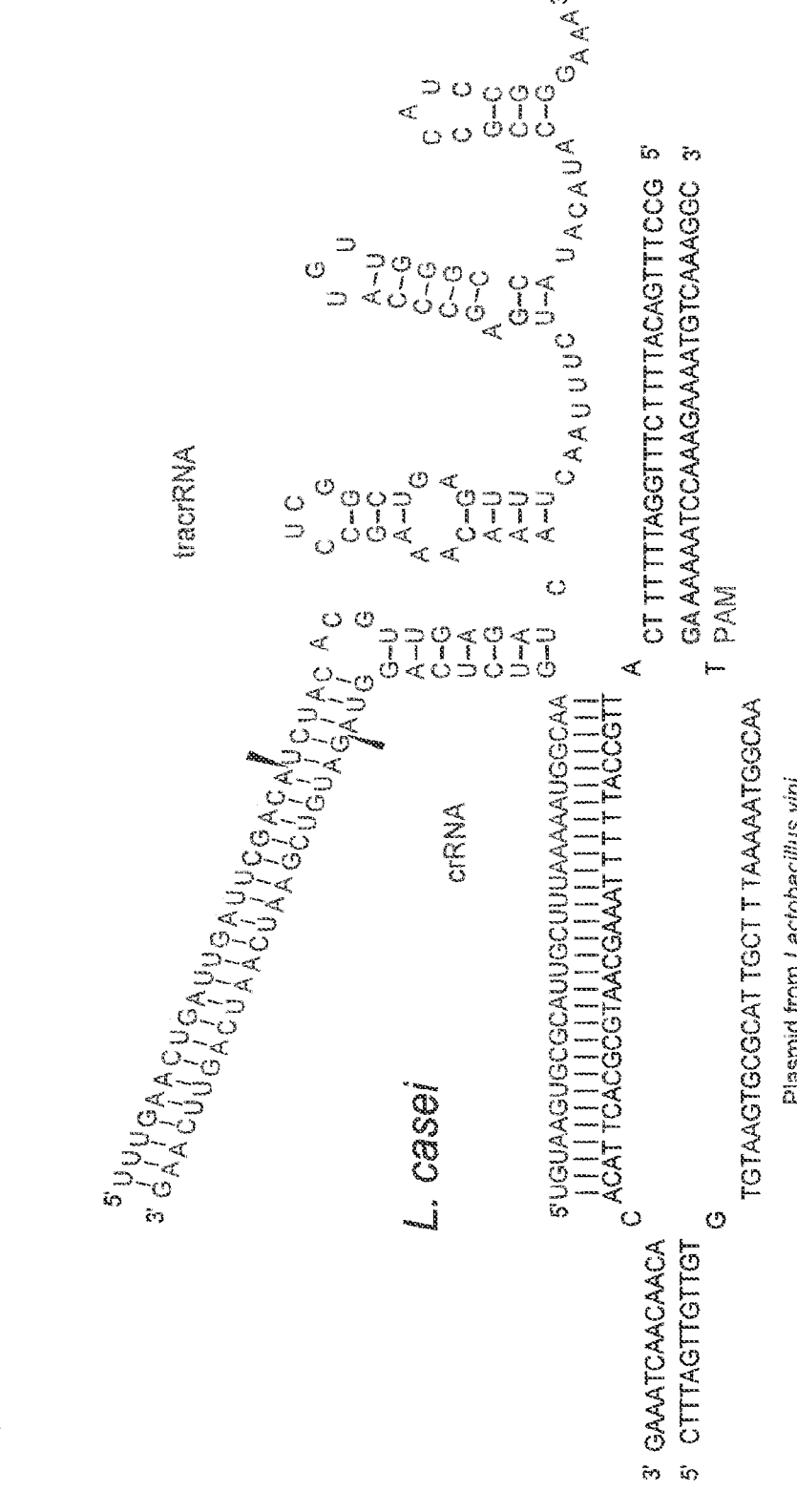
FIG. 18 shows sequence and structural details for CRISPR-Cas system elements for the *Lactobacillus casei*, representing the Lca group (SEQ ID NOs:158-161).
Figure 19:
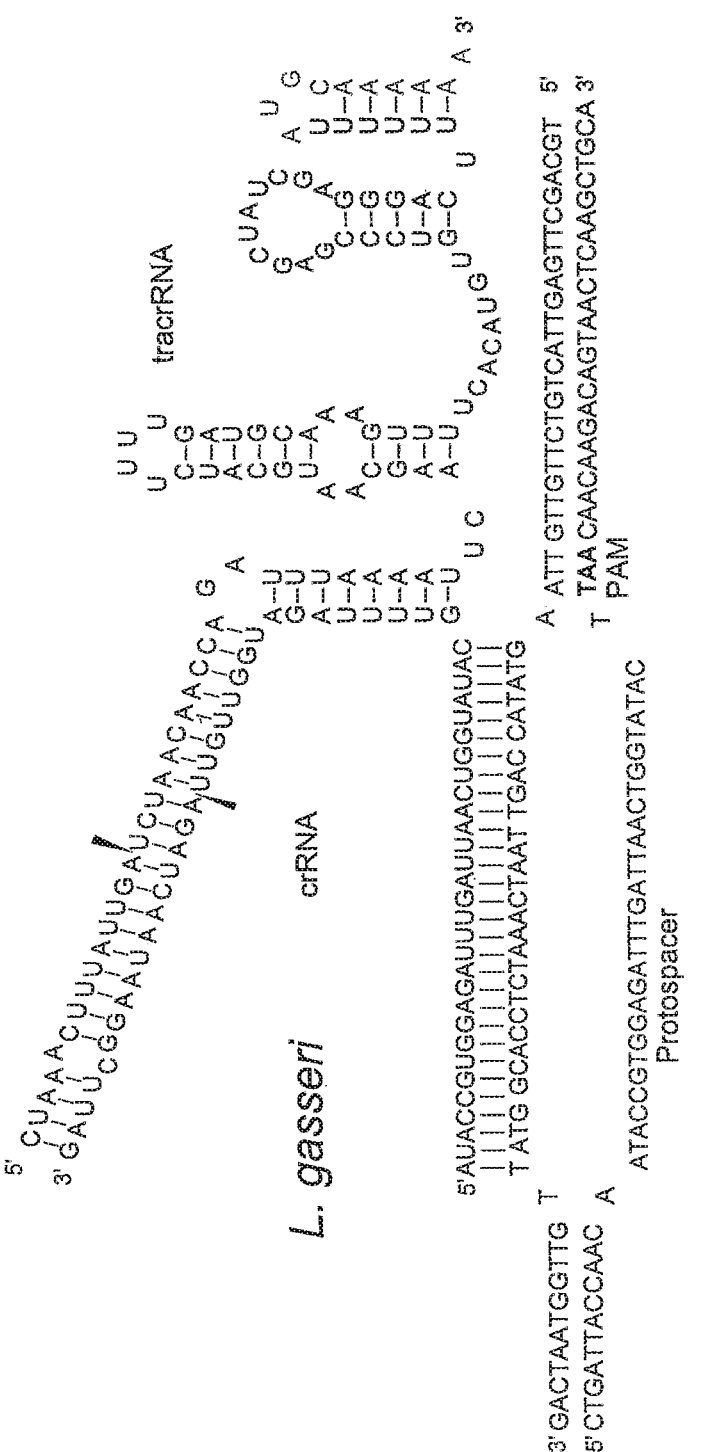
FIG. 19 shows sequence and structural details for CRISPR-Cas system elements for the *Lactobacillus* gasseri, representing the Lga group (SEQ ID NOs:162-165).

A multiple sequence alignment for the zipper module is provided in FIG. 9 with FIG. 10 showing a maximum likelihood tree for the zipper module.

Figure 4:
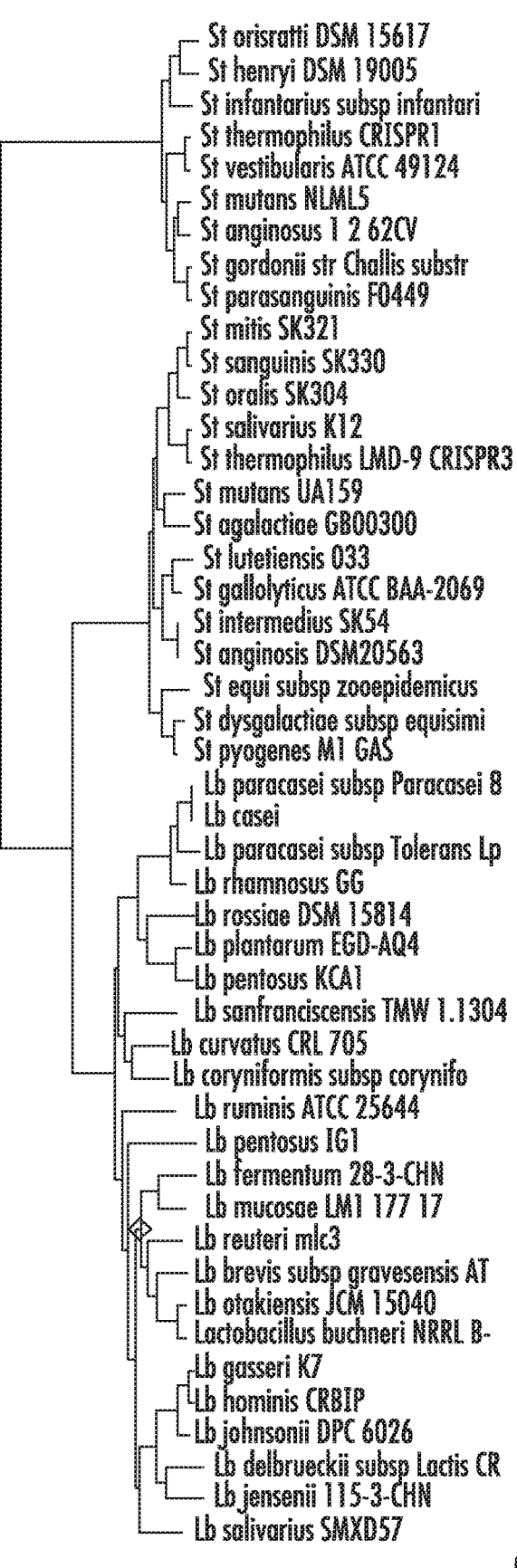
FIG. 4 shows a maximum likelihood tree for Cas9 nucleases.

FIG. 11 shows a multiple sequence alignment for the bulge, anti-stitch and nexus modules. FIG. 4 shows a maxi-mum likelihood tree for Cas9 nucleases.

Figure 21:
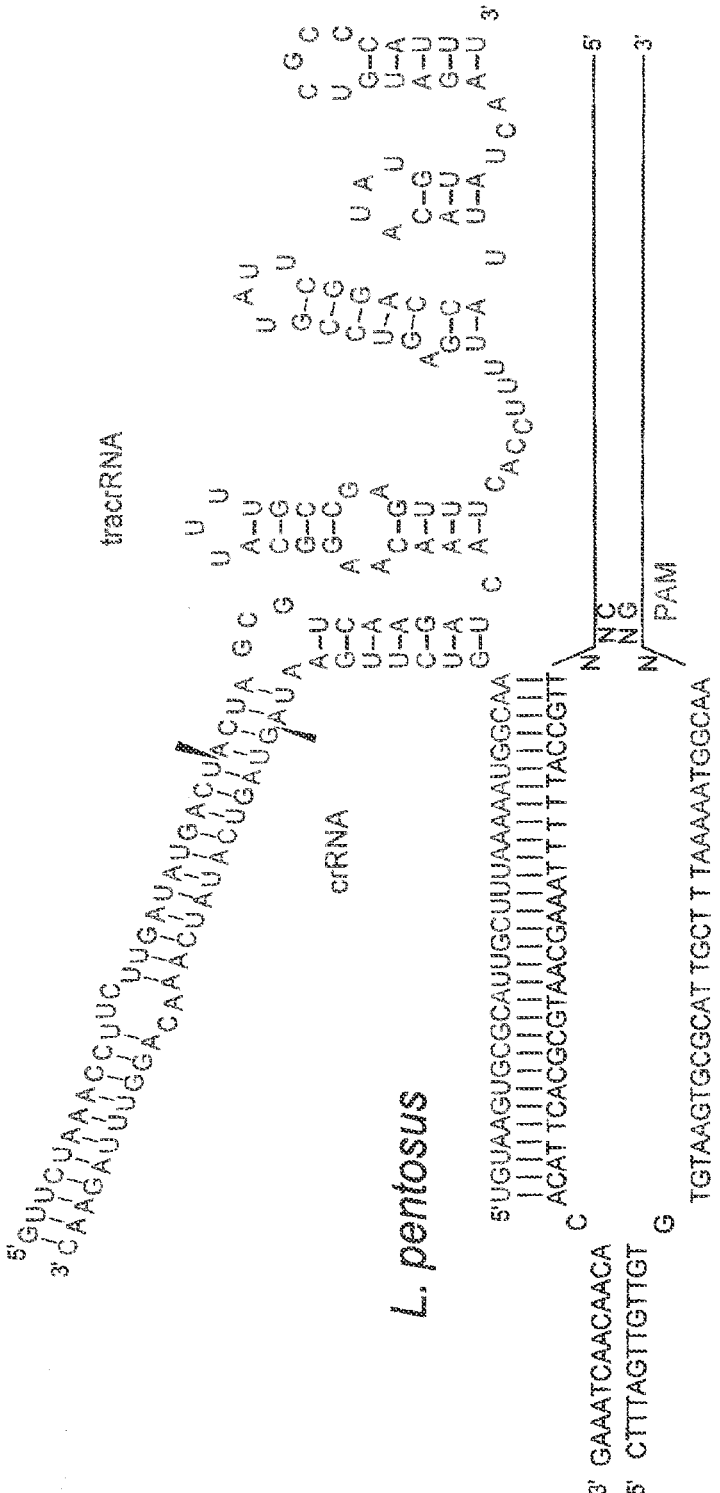
FIG. 21 shows sequence and structural details for CRISPR-Cas system elements for the *Lactobacillus pentosus*, representing the Lpe group (SEQ ID NOs:170-173).

FIGS. 12-21 show guide sequences and targeting for various cRNA:tracRNA constructs including *Streptococcus thermophilus* CR3, representing the Sth CR1 group (FIG. 12); *Lactobacillus buchneri*, representing the Lbu group (FIG. 13); *Streptococcus thermophilus* CR1, representing the Sth CR1 group (FIG. 14); *Streptococcus* pyrogenes M1 GAS, representing the Sth CR3 group (FIG. 15); *Lactoba-cillus rhamnosus*, representing the Lrh group (FIG. 16); *Lactobacillus animalis*, representing the Lan group (FIG. 17); *Lactobacillus casei*, representing the Lca group (FIG. 18); *Lactobacillus* gasseri, representing the Lga group (FIG. 19); *Lactobacillus jensenii*, representing the Lje group (FIG. 20); and *Lactobacillus pentosus*, representing the Lpe group (FIG. 21). The lower portion of each of FIGS. 12-21 represents target dsDNA, including the target sequence (open structure) and the flanking (3') PAM. The upper portion of each figure represents the CRISPR RNA (crRNA), which consists of a 5' portion complementary to the target sequence, as well as a 3' portion derived from the CRISPR repeat; and also represents the tracrRNA, which consists of an anti-CRISPR repeat portion, as well as the nexus and 3' hairpins. As shown in each of FIGS. 12-21, the complementary portion of the crRNA:tracrRNA duplex con-sists of the lower stem (bottom complementary portion), a bulge (herniated mismatch) and upper stem (top comple-mentary portion).

Figure 23:
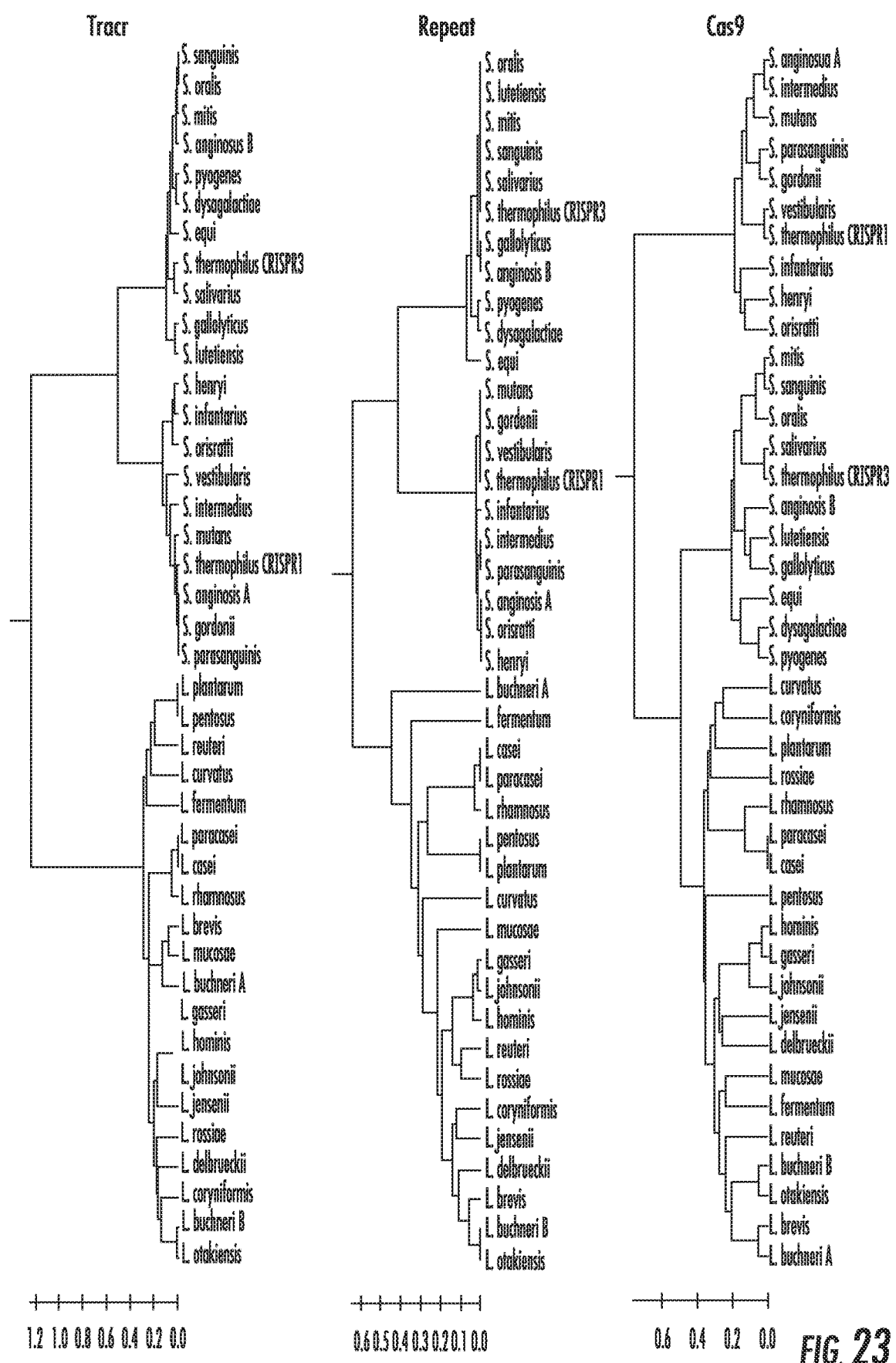
FIG. 23 shows congruence between tracrRNA (left), CRISPR repeat (middle) and Cas9 (right) sequence clustering. Consistent grouping is observed across the three sequence-based phylogenetic trees, into three families.

Example 2. Determination of Guide RNA Sequence Features in Various Additional Type II Systems The findings described in Example 1 establish important modules in sgRNA that are required to support *Streptococ-cus* pyrogenes Cas9 (SpyCas9) activity. However, while used widely for genome editing, SpyCas9 is merely one of many Cas9 orthologs found naturally (Chylinski, K. et al. *RNA biology* 10, 726-737 (2013); Fonfara, I. et al. *Nucleic Acids Res* (2013)). We therefore next investigated whether the same sgRNA sequence features also occur in other Type II CRISPR-Cas systems. We sampled 41 Cas9 sequences from *Streptococcus* and *Lactobacillus* genomes, in which Type II systems preferentially occur[2] and identified their corresponding CRISPR repeat and predicted tracrRNA sequences. The Cas9 protein sequences clustered into three main sequence groups (FIG. 23). Similar grouping was observed when clustering was carried out using either CRISPR-repeat or predicted tracrRNA sequences (FIG. 24A, FIGS. 23, 25, 26), as anticipated, given the presence of an anti-CRISPR repeat within the tracrRNA, and the intimate molecular relationship between Cas9 and crRNA: tracrRNA pairs (Makarova, K. S. et al. *Nat Rev Microbiol* 9, 467-477 (2011); Deltcheva, E. et al. *Nature* 471, 602-607 (2011); Fonfara, I. et al. *Nucleic Acids Res* (2013)). Within the tracrRNA sequences, we consistently observed the functional modules identified for SpyCas9 (FIG. 24B), with conservation of the overall sgRNA/crRNA:tracrRNA structure between families, and high levels of sequence conservation within clusters.

Figures 27A, 27B:
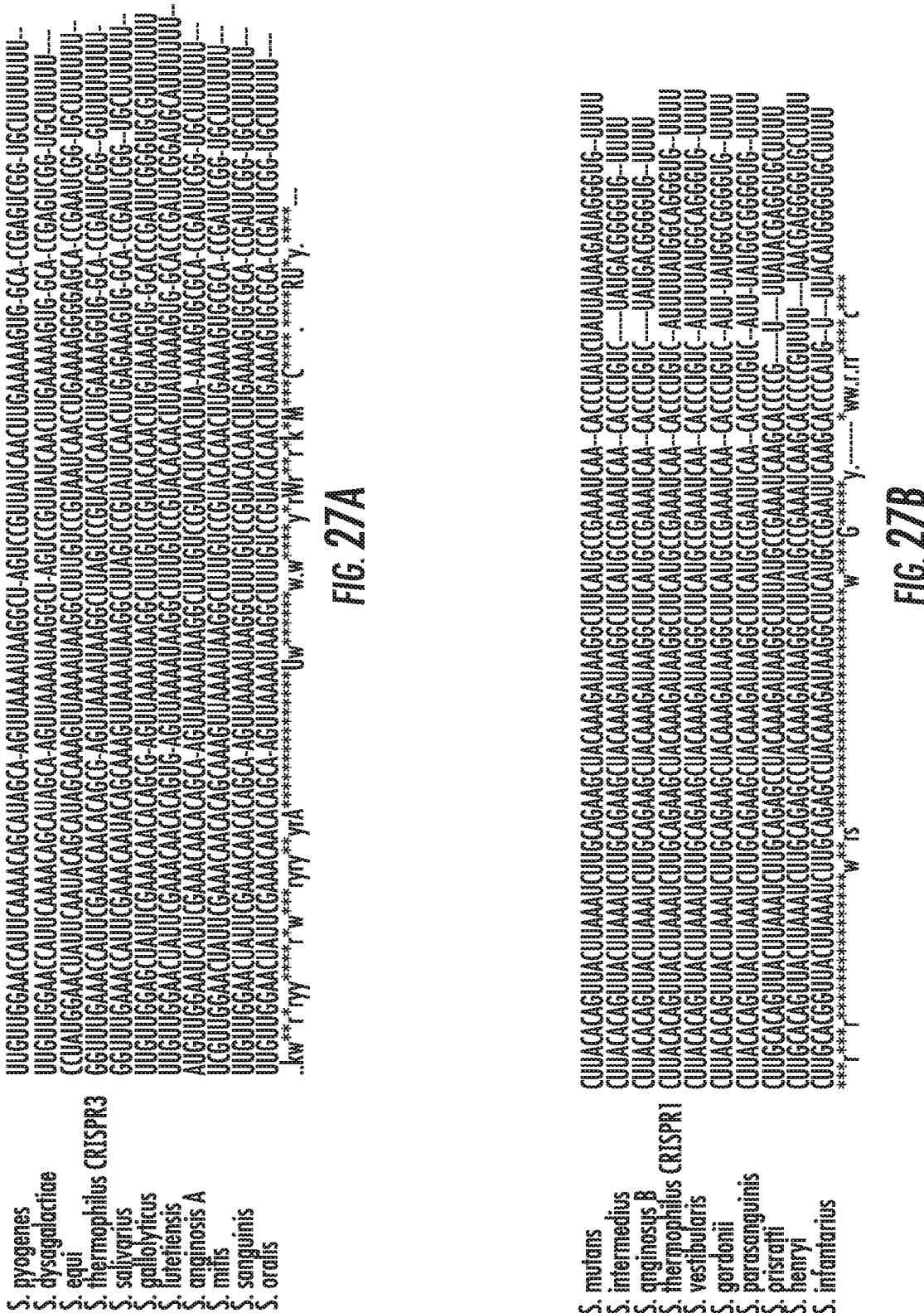
FIGS. 27A-27C shows sgRNA nexus sequence alignment (SEQ ID NO:229-266). Universally conserved residues are shown. Complementary nucleotides that constitute the nexus stem are summarized in FIG. 24B. Nucleotides that constitute the nexus loop are centered in the gap.
Figure 27C:
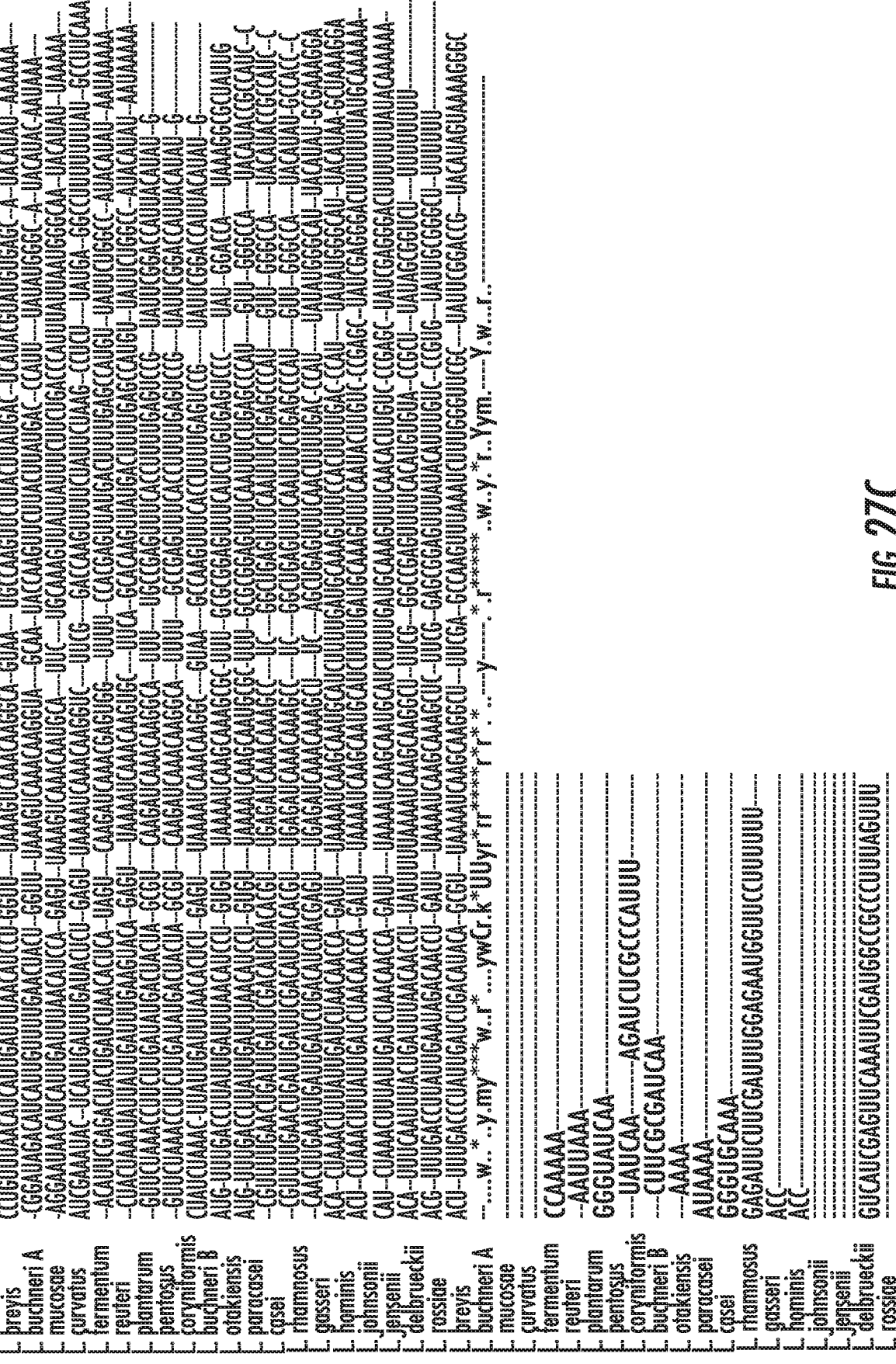

The presence of a bulge with a directional kink between the lower stem (i.e., stitch/anti-stitch) and the upper stem (i.e., zipper/anti-zipper) was observed consistently across a diversity of systems. The length of the lower stem was highly conserved within, and variable between, families. Interestingly, the highest level of conservation was observed for the nexus sequences (FIG. 24B, FIG. 27). The general nexus shape with a GC-rich stem and an offset uracil was shared between the two *Streptococcus* families. In contrast, the idiosyncratic double stem nexus (FIG. 24A-B) was unique to, and ubiquitous in, *Lactobacillus* systems. Remarkably, some bases within the nexus were strictly conserved even between distinct families (FIG. 24A-B), including A52 and C55, further highlighting the critical role of this module. Actually, A52 interacts with the backbone of residues 1103-1107 close to the 5' end of the target strand in the in the crystal structure of SpyCas9, suggesting that the interaction of the nexus with the protein backbone may be required for PAM binding.

Figures 28A, 28B:
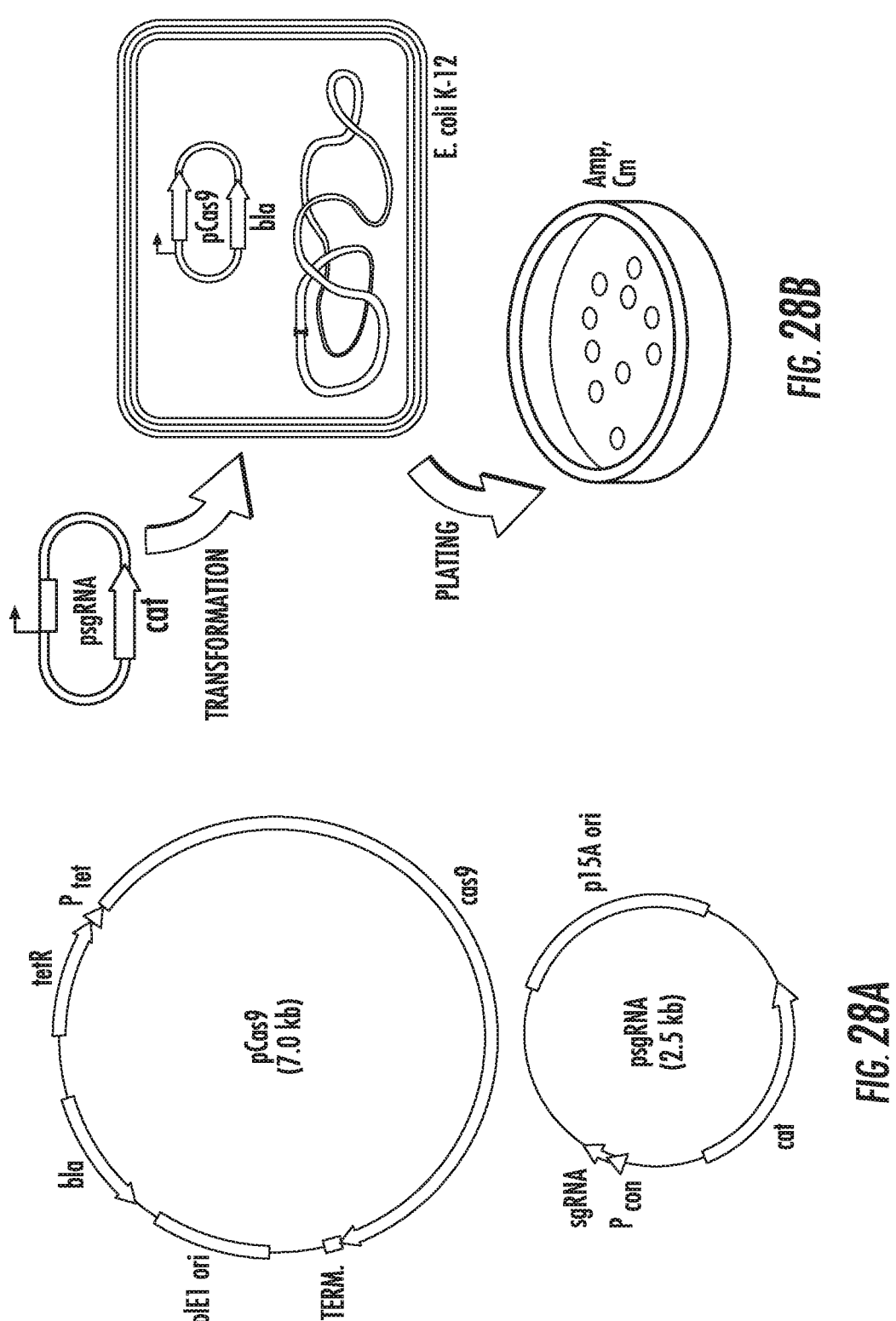
FIG. 28A-B shows a self targeting assay scheme. Orthogonal Cas9 proteins were provided through the pCas9 plasmid (FIG. 28A), and used as described in FIG. 3. Various sgRNA chimera were provided through the psgRNA plasmid (FIG. 28B), and used in combination with each desired Cas9 as described in FIG. 3.
Figures 29A, 29B, 29C:
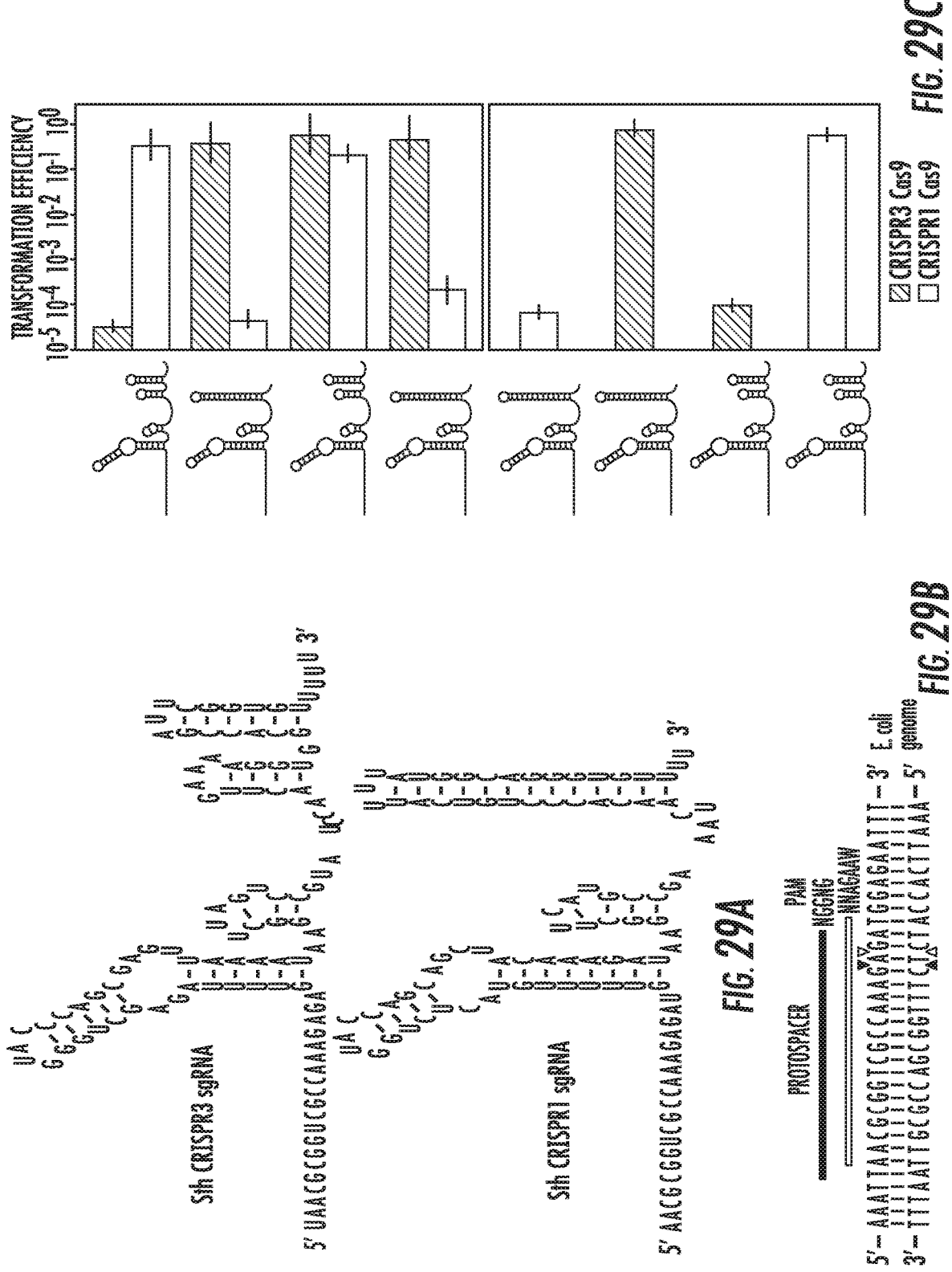
FIG. 29A-C shows sgRNA orthogonality.

Determining the relationship of structure of the guide RNA to orthogonality of Cas9 proteins. The findings described herein suggest a potential relationship between the structure and sequence of the sgRNA and the diversity of Cas9 proteins. This observation prompted us to determine the sgRNA modules that define Cas9 orthologous groups. Thus, we selected the endonucleases from the two naturally co-existing orthologous *S. thermophilus* Type II systems, namely Sth1Cas9 and Sth3Cas9 (Horvath, P. et al. *J Bacteriol.* 190, 1401-1412 (2008)), to investigate the link between sgRNA composition and Cas9 orthogonality. A series of experiments were designed based on self-targeting activity in *Escherichia coli* (FIG. 28A-B) to test whether specific mutations in a sgRNA could facilitate cleavage activity with a previously orthologous Cas9. We identified a region within the *E. coli* genome that contained overlapping Cas9 target sites for the Sth1Cas9 and Sth3Cas9 systems to ensure that cleavage occurred within one nucleotide (FIG. 29B) and that the PAM sequences were conveniently overlapping. We generated chimeric versions of the two sgRNA backbones and interchanged the spacer, lower stem (ie. stitch/antistitch)-bulge-upper stem (i.e., zipper/anti-zipper), nexus and hairpins (FIG. 29C), and tested their ability to drive self targeting (Gomaa, A. A. et al. *MBio.* 5, e00928-13 (2014)) by either Sth1Cas9 or Sth3Cas9. First, we confirmed that these two systems are indeed orthogonal in this assay system, and that each guide solely drives targeting with its cognate Cas9 (FIG. 29C). Next, we demonstrated that swapping the spacer sequences results in a sgRNA with a CRISPR3 spacer and a CRISPR1 backbone able to support Sth1Cas9 cleavage activity. However, the reverse is not true of Sth3Cas9 activity.

A sgRNA containing a CRISPR1 spacer and a CRISPR3 backbone does not support Sth3Cas9 activity (FIG. 29C). We hypothesize that this unidirectional cross-functionality is due to flexibility in the requirement for spacing between the PAM and the protospacer within the SthCRISPR1 system (Chen et al. *J Biol. Chem.* doi: 10.1074/jbc.M113.539726. (2014)) (FIG. 29C, upper panel). We then demonstrated that functionality between the sgRNA and Cas9 can be switched solely by exchanging the nexus-hairpin combination between two orthogonal systems. A major consequence of re-programming the sgRNA is that the ability to guide the original Cas9 is lost in that process (FIG. 29C, lower panel). This contrasts with the canonical view that the CRISPR repeat sequence plays a key role in defining orthologous CRISPR-Cas systems. Altogether, these results show that chimeric sgRNAs with altered nexus sequences can reprogram orthogonality in a predictable and unidirectional manner, which is critical for further harnessing orthogonal Cas9 proteins associated with different PAMs (Esvelt, K. M. et al. *Nature Methods* (2013)).

Recent structural and biochemical data has begun to shed light on the mechanism of DNA recognition and cleavage by Cas9 (Jinek, M. et al., *Science* 337, 816-821 (2012); Jinek, M. et al., *Science* 343, 6176 (2014); Nishimasu, H. et al. *Cell* 156, 935 (2014)). Electron micrographs of the apo-, RNA-bound and protein/RNA/DNA complexes indicated that upon binding guide RNA, Cas9 undergoes a dramatic conformational change to facilitate target DNA binding and cleavage structures (Jinek, M. et al., *Science* 343, 6176 (2014). Crystal structures show that, consistent with images from the electron microscope, the SpyCas9:sgRNA:DNA: complex and apo-SpyCas9 occupy significantly different conformations, with substantial rearrangement of RNA- and DNA-binding domains taking place between the two structures (Jinek, M. et al., *Science* 343, 6176 (2014); Nishimasu, H. et al. *Cell* 156, 935 (2014)). The nexus occupies a critical position in the SpyCas9-sgRNA:DNA complex, coordinating a number of key components of the protein and sgRNA, positioning both protein and RNA appropriately to receive target DNA duplexes for cleavage. Upon binding sgRNA: DNA, the arginine-rich bridge helix binds to the base of the nexus and to the lower stem. Additionally, the nexus interacts with two small regions (which we propose to establish as Nexus Interacting Region 1 (NIR1) 446-497 and Nexus Interacting Region 2 (NIR2) 1105-1138) from the two lobes of SpyCas9. Both of these regions are disordered in the apoSpyCas9 structure, and notably contain two tryptophan residues identified as being important in PAM recognition[2]. NIR2 also interacts directly with the lower stem, and the face opposite the nexus-binding site lies in close proximity to the 3' end of the target strand, suggesting that interaction with the nexus may be required to order the PAM recognition site. Notably, in the *Actinomyces naeslundii* Cas9 (AnaCas9) apo-structure (Jinek, M. et al., *Science* 343, 6176 (2014)), NIR2 is ordered, and contains an about 50 amino acid insertion. It is tempting to speculate that AnaCas9 may recognize a larger nexus and possibly accompanying PAM sequence.

Altogether, these results reveal that there are six distinct features within guide RNAs and establish the bulge and nexus as structure- and sequence-specific features that guide Cas9 targeting and cleavage. This provides a basis for optimization of sgRNA composition and design with the opportunity to engineer short, minimal guide RNAs that contain smaller regions of double-stranded RNA potentially triggering innate immune responses, and are more amenable to packaging into, for example, adeno-associated viruses. This understanding of Type II CRISPR-Cas systems is corroborated by Briner et al. (*Mol. Cell* 56:333-339 (2014)) and Nishimasu et al. (*Cell* 156:935-949 (2014), wherein it is shown that modifications of the sequences that impact the ability of the modified sequences to guide Cas9. Noteworthy, these studies confirm that the nexus sequence within the guide is critical in guiding Cas9 towards complementary DNA and subsequent cleavage.

The ability to reprogram Cas9 orthogonality using chimeric sgRNAs with altered nexus sequences opens new avenues for the exploitation of novel Cas9 proteins, with the potential to harness the diversity of natural Cas9 orthologs, including short Cas9 variants for convenient packaging and delivery. Additionally, the ability to reprogram Cas9 using chimeric mgRNAs will allow for increased use of various PAMs for flexible management of target frequency (short PAMs with frequent occurrence) and specificity by reducing off-target cleavage (longer PAMs with infrequent occurrence). This also expands multiplexing opportunities, by using a single Cas9 with various chimeric guides, or by concurrently using orthogonal systems with different combinations of standard or chimeric sgRNAs. Collectively, our findings open up new avenues for Cas9-dependent DNA targeting, and set the stage for the development of next-generation CRISPR-based technologies.

Example 3

The cas9 genes from the CRISPR1 locus and the CRISPR3 locus were PCR amplified from genomic DNA from *S. thermophilus* LMD-9, and cloned into pwtCas9-Bacteria (Addgene #44250)) (Qi, L. S. et al. *Cell* 152, 1173-1183 (2013)). To construct the sgRNA-expressing plasmids, the SpeI restriction site in the pdCas9-bacteria plasmid (Addgene #44249) (Id.) was removed and a gBlock (IDT) encoding azraP-targeting sgRNA based on the CRISPR1 or the CRISPR3 locus was combined with the PCR-amplified backbone of the pgRNA-bacteria plasmid (Addgene #44251) (Id.). *E. coli* K-12 was used for transformation assays, and transformation efficiency was calculated by dividing the number of transformants for the tested sgRNA plasmid by the number of transformants for the psgRNA-C1-T4 control plasmid, as described previously (Gomaa, A. A. et al. MBio. 5, e00928-13 (2014)).

Plasmid construction. To construct the Cas9-expressing plasmids, the Cas9 genes from the CRISPR1 locus (Sth1-Cas9) and the CRISPR3 locus (Sth3-Cas9) were PCR amplified from genomic DNA extracted from *S. thermophilus* LMD-9. Each PCR product was combined with the PCR-amplified backbone of pwtCas9-Bacteria (Addgene #44250) (Qi, L. S. et al. *Cell* 152, 1173-1183 (2013)) by Gibson assembly. To construct the sgRNA-expressing plasmids, the SpeI restriction site in the pdCas9-bacteria plasmid (Addgene #44249) (Id.) was removed by digesting the plasmid with SpeI, blunt ending, and religating to generate the pdCas9ΔSpeI plasmid. Separately, a gBlock (IDT) encoding a zraP-targeting sgRNA based on the CRISPR1 (C1) locus or the CRISPR3 (C3) locus in *S. thermophilus* LMD-9 was combined with the PCR-amplified backbone of the pgRNA-bacteria plasmid (Addgene #44251) (Id.) by Gibson assembly, thereby replacing the original *S. pyogenes* sgRNA sequence with the designed sgRNA sequence. The resulting sgRNA plasmids and the pdCas9ΔSpeI backbone were then digested with AatII and XhoI, and the gel-extracted fragment of each sgRNA plasmid and the pdCas9ΔSpeI plasmid were ligated together, forming psgRNA-SthC1 and psgRNA-SthC3. To modify the sgRNA sequences, 5' phosphorylated oligonucleotides were annealed and ligated into the SpeI/KpnI or KpnI/HindIII sites of the psgRNA-C1 plasmid or the psgRNA-C3 plasmid. All plasmid modifications were verified by sequencing.

Strains and growth conditions. *E. coli* K-12 subst. MG1655 (genotype: *E. coli* K-12 F λ-ilvG-rfb-5C rph-1) was used for all transformation assays. The strain was grown aerobically in LB medium (10 g/L tryptone, 5 g/L yeast extract, 10 g/L sodium chloride) at 37° C. and 250 RPM unless indicated otherwise. The medium was supplemented with antibiotics (34 μg/ml of chloramphenicol, 50 μg/ml Ampicillin) as appropriate.

Figure 30:
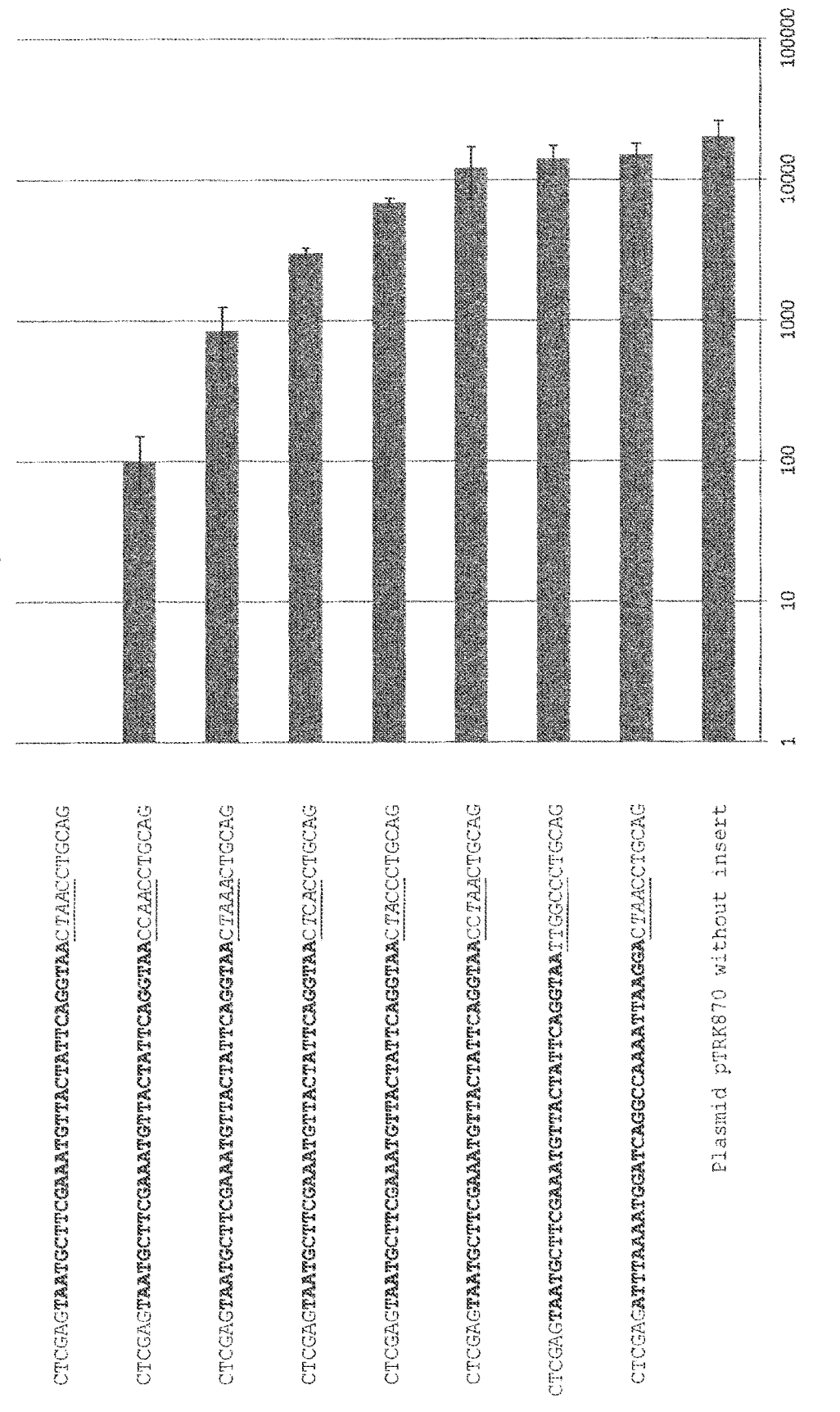
FIG. 30 shows CRISPR interference against complementary DNA (SEQ ID NOs:271-278), as inability to transform plasmids that contain protospacer sequences that match the first wild type CRISPR spacer sequence, in *Lactobacillus* gasseri. The bold sequence, flanked by a PAM (light grey, italicized nucleotides) and variants thereof (single nucleotide polymorphisms (SNPs); black underlined nucleotides) is the protospacer. Low transformant counts represent an active Lga CRISPR systems which precludes transformation of complementary target DNA.
Figure 31:
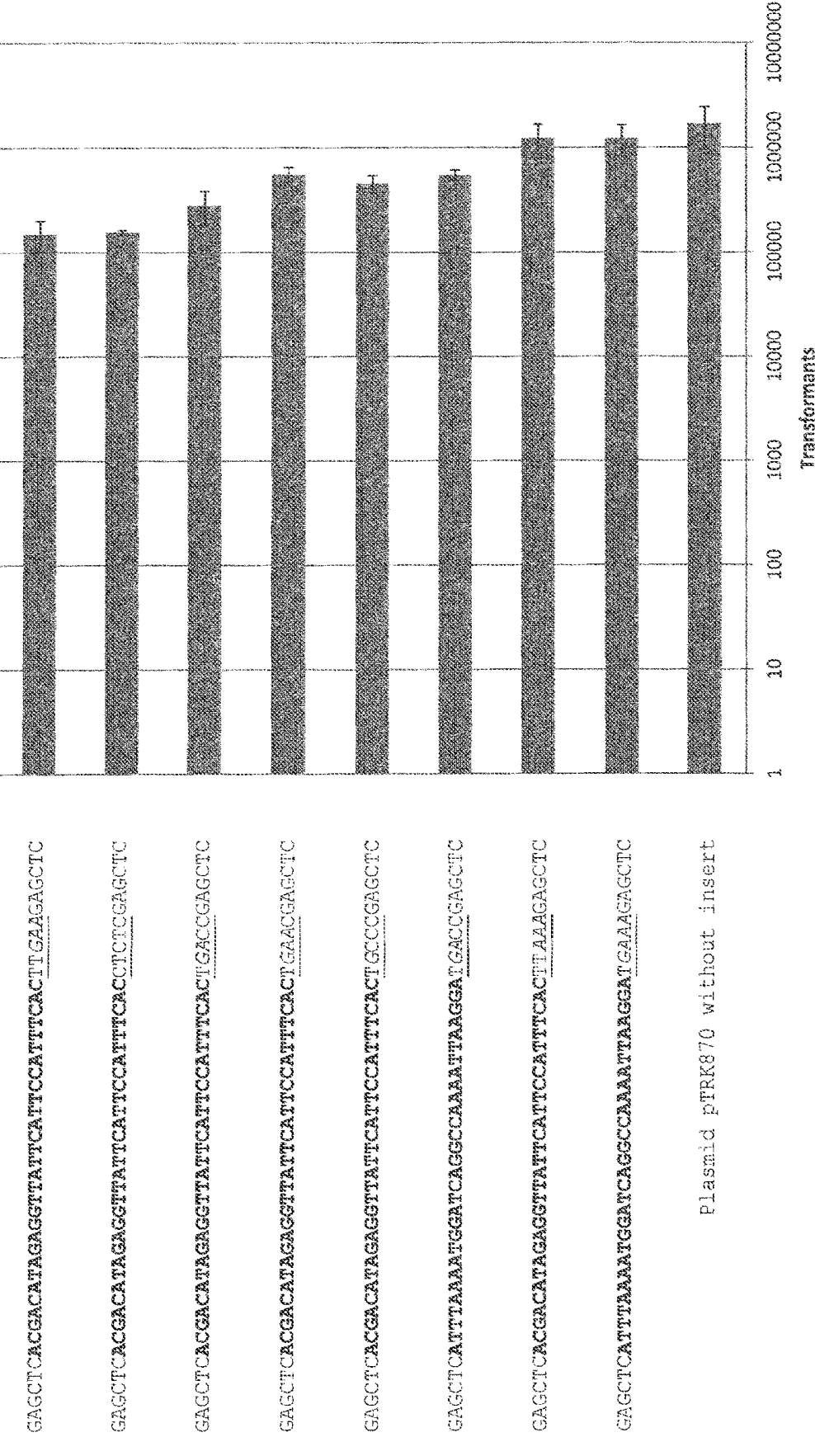
FIG. 31 shows CRISPR interference against complementary DNA (SEQ ID NOs:279-286), as inability to transform plasmids that contain protospacer sequences that match the first wild type CRISPR spacer sequence, in *Lactobacillus* casei. The bold sequence, flanked by a PAM (light grey, italicized nucleotides) and variants thereof (SNPs, black underlined nucleotides) is the protospacer. Low transformant counts represent an active Lca CRISPR systems which precludes transformation of complementary target DNA.
Figure 32:
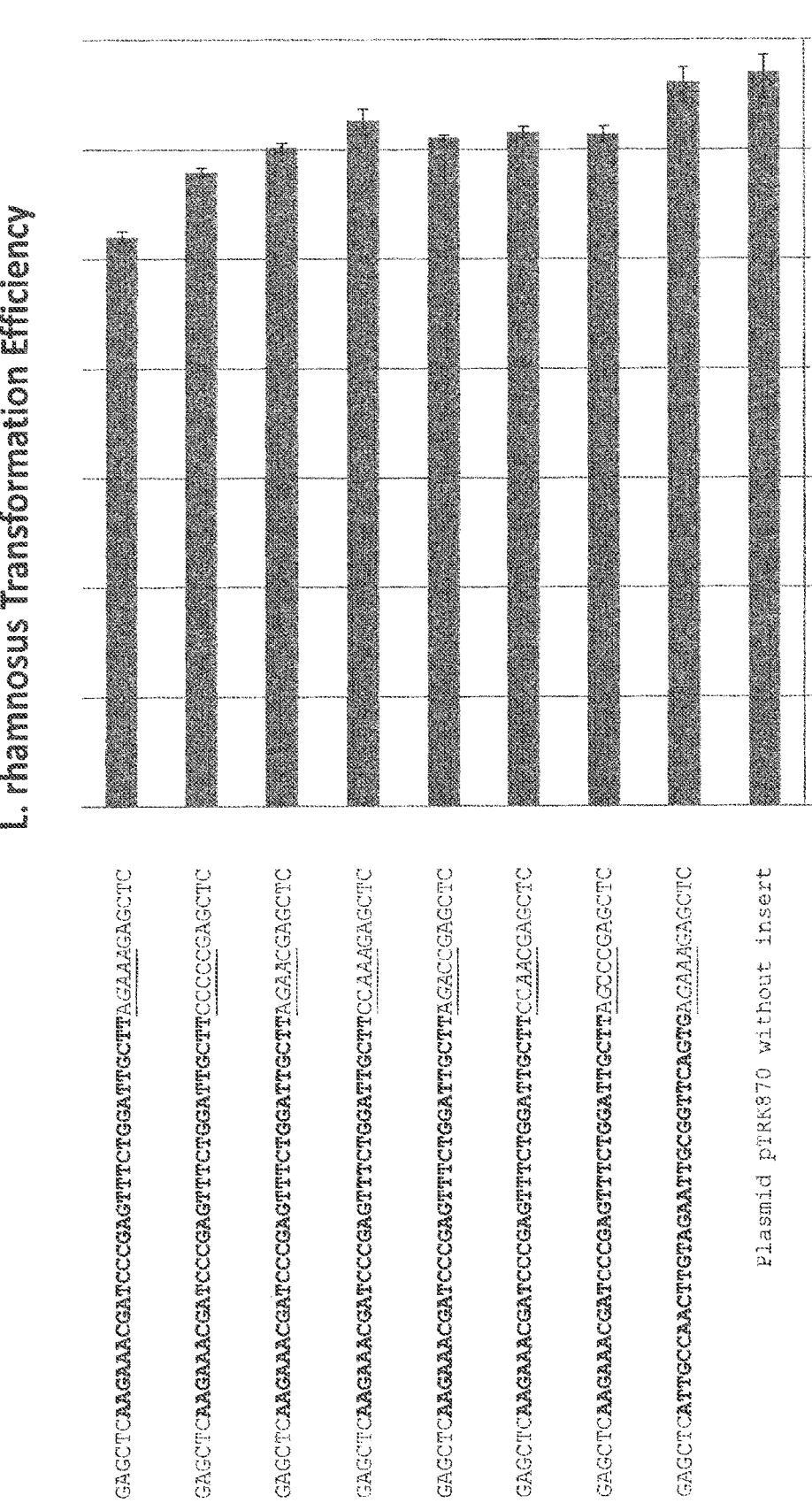
FIG. 32 shows CRISPR interference against complementary DNA (SEQ ID NOs:287-294), as inability to transform plasmids that contain protospacer sequences that match the first wild type CRISPR spacer sequence, in *Lactobacillus*

Transformation assay. Freezer stocks of cells harboring the indicated Cas9-expressing plasmid were streaked to isolation and individual colonies were inoculated into 3 ml of LB medium and cultured overnight. The resulting cultures were back-diluted into 45 ml of LB medium and grown to an $ABS_{600}$ of 0.6-0.8 as measured on a Nanodrop 2000c spectrophotometer (Thermo Scientific). The cultures were then pelleted and washed with ice-cold 10% glycerol twice before being resuspended in 200-400 μl of 10% glycerol. Suspended cells (50 μl) were transformed with 25 ng of the indicated sgRNA-expressing plasmid using a MicroPulser Electroporator (BioRad) and recovered in 300 μl of SOC medium (Quality Biological) for 1 hour. After recovery, 200 μl of cultures with different amounts of LB medium were plated on LB agar with 100 ng/ml of anhydrotetracycline. The transformation efficiency was calculated by dividing the number of transformants for the tested DgRNA plasmid by the number of transformants for the psgRNA-C1-T4 control plasmid, as described previously (Gomaa, A. A. et al. MBio. 5, e00928-13 (2014)). In order to reduce experiment-to-experiment variability in transformation efficiency, the tested sgRNA plasmid and the control plasmid were transformed into the same batch of electrocompetent cells. Similarly, for FIGS. 30-32, transformation assays were used to test the ability of a plasmid to be electroporated into *Lactobacillus* strains that carry active CRISPR-Cas systems (Lbu—*Lactobacillus buchneri*, FIG. 30; Lrh—*Lactobacillus rhamnosus*, FIG. 32; Lca—*Lactobacillus casei*, FIG. 31. The plasmid was engineered as to contain a protospacer sequence identical to the first spacer sequence in the CRISPR locus of the host. Various plasmids were engineered as to flank the protospacer with a perfect PAM (NTAAC for Lga; NNGAA for Lca; NGAAA for Lrh; the PAM region is the underlined nucleotides in FIGS. 30-32, and mutated variants thereof (the nucleotides being tested for efficiency are italicized). Experiments also included a control non-targeting sequence (next to last entry for each experiment shown in FIGS. 30-32, as well as a control plasmid with no target sequence (last entry for each experiment shown in FIGS. 30-32. The ability of the native CRISPR-Cas system to interfere with plasmid uptake by DNA targeting is measured as the difference in transformation efficiency between the test sequence and that of the two aforementioned controls.

SEQUENCE LISTING (296 sequences)

SEQ ID NO: 1 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 2 - protein, 1128 aa, Streptococcus vestibularis ATCC 49124
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 3 - protein, 1128 aa, Streptococcus mutans NLML5
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 4 - protein, 1125 aa, Streptococcus anginosus 1 2 62CV
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 5 - protein, 1136 aa, Streptococcus gordonii str. Challis substr. CH1
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 6 - protein, 1140 aa, Streptococcus parasanguinis F0449
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 7 - protein, 1129 aa, Streptococcus orisratti DSM 15617
MTNGKILGLDIGIASVGVGVIEADTGKVVHASSRLFPSANADNNAERRGFRGGRRLIRRKKHRMKRVKDLFEEYKLETRFNNLNLNPYELRVRGLTEKLAPEELFAALKNLSKHRGISYLDDAEDDNASAKTNYAKSVLANKELLKTRTPGQIQWERFEKYGQIRGDFDIVTPEGEQQRIINVFSTTDYKKEAEQILETQALYYPQISSEFIEDFITILTSKRKYYHGPGNEKSRTDYGRYRTDGTTLDNIFDILVGKCGIYPDEYRAAKASYTAQEFNFLNDLNNLTLPTETKRLSTDQKKDLVRFATTAATLGPDKLLKEIARMVGCSKDDIKGYRIDNKEKPDLHTFEAYRAMTKLNTFDVATFSREMIDELARILTLNTDREGIEEAIVNDFPNLFSREQIDELIQFRKSKSQLFGKGWHSFSLKLMSELIPELYATSEEQMTILTRLNKMSPERKVTLRTKYINEQDATEEIYNPVVAKSVRQAIKIINECIKKWGEFDQIVIEMPRDKNEDDEKKRIADGQKANAKEKASATEFAASLYNGKKELPDEVFHGHKQLATKIRLWYQQDGKCLYTGQDISIHDLIHNQNQYEIDHIMPLSLSFDDSLSNKVLVLATANQEKGQQTPYQAIPKMKSAWSYREFKAFVLDCKRLSKKKREYLLTEEDIDKIEVRRKFIARNLVDTRYASRVVLTTLQDALEVMNKETKVSVVRGQFTSQLRRQWKIDKTRDTYHHHAIDALIIAASSQLKLWKKQDNPMFEEYEQGQKINLETGEILSDDDYKKLVFQSPYQGFVHTISSKSFEDEILFSYQIDSKVNRKISDATIYATRQAQLSRDRKKETYVLGKIKDIYSQTGYDAFRKRYDKDKTVFLMYQKDPLTWEKVIEVILRDYKEFDDKGKEVGNPFERYRQQNGLMTKYSRKNKGTPIKALKYYDNKLGNHVDVTPDDSKNPVVLQSINPWRADLYFNPKTAKYELLGLKYADLSFEKGTGNYTISQEKYDEIKKREGISAESEFKFTLYKNDLLLIKDIENGEEQVFRFLSRTMPNQKHYVELKPYDKAKFDGGQSLLTVLGTVAKGGQCLKSLNKVGISIYKVKTDVLGYQHFIKKEGNQPKLSFENSIKRHKNK

SEQ ID NO: 8 - protein, 1126 aa, Streptococcus henryi DSM 19005
MTNGLVLGLDIGIASVGVGIIEAETGKVIHASSRIFPAANADNNAERRGFRGGRRLTRRKKHRVKRVRDLFDDYNIATDFSNLNLNPYELRVKGLTEELTNEELFAALRNISKRRGISYLDDAEDDANSGKTDYAKSVLANKELLKTQTPGQIQLDRLNKYGQLRGDFDVVDENGEIHRVINVFSTSDYRKEAEKILQTQSQFNNAINQEFINDYIDILVSKRKYYHGPGNEKSRTDYGRYRTDGRTLENIFDILVGKCTFYPEEYRAAKASYTAQEFNFLNDLNNLTLPTETKKLSIEEKLYLVDYAKNTPVLGPDKLLKEIAKLVDCKKEDIKGFRIDNKEKPDMHTFEVYRTMSKLDKVDIQTLSRETFDELARILTLNTEREGIEEAILKDLPNQFTNEQIEELIKFRKDKSQIFGKGWHNFSVKLMLELIPELYDTSEEQMTILTRLGKTSANKKEVKRTKYINENDVTEEIYNPVVVKSVRQAIKIINASVKEWGEFDNIVIEMPRETNADDERKFIKKMQDANAKEKKDSEERAATLYNGKTELPSNIFHGHNQLATKIRLWYQQGERCIYTGQKIDINDLIHNHNMYEIDHVLPLSLSFDDSLANKVLVLATANQEKGQKTPFQSIPQMKSAWSYREFKSYVLGCKGLSKKKREYLLTEEDINKIEVKQKFIERNLVDTRYASRVVLNTLQDSLKAMNKKTRVSVVRGQFTSQLRRQWKIDKSRETYHHHAIDALIIAASSQLRLWKKQGDTMFEDYKNGQKVDLETGELLSDNEYKELVFQSPYQGFVNTISSKAFEDEILFSYQVDSKVNRKISDATIYATRQAKLTKDKKEETYVLGKIKDIYSQAGYDAFRKRYEKDKSAFLMYQKDPMTWEKVIEVILNDYCEFDDKGKETGNPFEKYRNENGYIRKYSRKGKGTEIKSLKYYDSKLGNHIDITPENSKNSVVLQSINPWRADLYFNPKTLKYELMGLKYSDLSFEKGTGNYSISQDKYDEIKSREGISPKSEFKFTLYKNDLILIKDTINNKTLTARFNSKNDTSKHYVELKPDSKAKYDSEEVLIPVFGKVAKSGRFIKGINKTGISIYKIKTDILGRKHFIKEEGDQPKLEFMKSSKNNK

SEQ ID NO: 9 - protein, 1129 aa, Streptococcus infantarius subsp. infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 10 - protein, 1388 aa, Streptococcus thermophilus LMD-9
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 11 - protein, 1385 aa, Streptococcus salivarius K12
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 12 - protein, 1392 aa, Streptococcus sanguinis SK330
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 13 - protein, 1392 aa, Streptococcus mitis SK321
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 14 - protein, 1373 aa, Streptococcus oralis SK304
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 15 - protein, 1370 aa, Streptococcus agalactiae GB00300
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 16 - protein, 1368 aa, Streptococcus pyogenes M1 GAS [sequence omitted]

SEQ ID NO: 17 - protein, 1371 aa, Streptococcus dysgalactiae subsp. equisimilis
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 18 - protein, 1348 aa, Streptococcus equi subsp. zooepidemicus
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 19 - protein, 1396 aa, Streptococcus anginosis DSM20563
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 20 - protein, 1345 aa, Streptococcus mutans UA159
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 21 - protein, 1370 aa, Streptococcus gallolyticus ATCC BAA-2069
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 22 - protein, 1373 aa, Streptococcus lutetiensis 033
MEKTYSIGLDIGTNSVGWSVITDDYKVPAKKMKVLGNTDKKYIKKNLLGALLFDSGETAEVTRLKRTARRRYTRRKNRLRYLQEIFAKEMAKVDESFFQRLEESFLTDDDKTFDSHPIFGNKAEEDAYHQEFPTIYHLRKHLADSSEKADLRLVYLALAHMIKFRGHFLIEGELNAENTDIQKLFNDFVETYDKIADESHLSEVDASSILTNKISKSRRLENLIKQYPTEKKNTLFGNLVALVLGLQPNFKTNFKLSEDAKLQFSKDTYDEDLEELLGKIGDDYADLFTAAKNLYDAILLSGILTVDDNSTKAPLSASMIKRYEEHHEDLEKLKKFIKVNNFDKYHEIFKDKSKNGYAGYIENGVKQDIFYKHLKSIISEKNGGQYFLDKIEREDFLRKQRTFDNGSIPHQIHLQEMRAILRRQGEYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTNRERSQSQQRLKKLQNSLKELGSNILNEEKPSYIEDKVENSHLQNDQLFLYYIQNGKDMYTGDELDIDHLSDYDIDHIIPQAFIKDNSIDNRVLTSSAKNRGKSDDVPSLDIVRARKAEWVRLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEEQTVGQNGGLFDNNILAKPEKDDKKKLFPIKKSLSTTSYGGYARATIAYSILIVSEFGKNKELKLLGLPLLDKVKYEKNPIAYLNSIGIINVKSIFKLPKYCLFEFQEKNTNYRRYMVSNQELKRANQLFLTCKETELVYKYIKSDNDNTHLVGNEKTILSIWNKLVIFMERTKLIDKKLFASLKQLKDEVDLINILDMTAKSLDFTKISAGQKKITISDSLSLPIKRWQFSSDEKMLKQLKTATLIHQSVTGLYETRIDLSKLGEE

SEQ ID NO: 23 - protein, 1246 aa, Streptococcus intermedius SK54
MRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 24 - protein, 1377 aa, Lactobacillus brevis subsp. gravesensis ATCC 27305
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 25 - protein, 1362 aa, Lactobacillus casei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 26 - protein, 1354 aa, Lactobacillus coryniformis subsp. coryniformis KCTC 3167
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 27 - protein, 1368 aa, Lactobacillus curvatus CRL 705
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 28 - protein, 1427 aa, Lactobacillus delbrueckii subsp. Lactis CRL581
MAKPKDYTIGLDIGTNSVGWVVTDDQNNILRIKGKKAIGARLFAEGKVAAERRSFRTTRRRLSRRRWRIKLLEELFDKEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQTLEELNDLFAENEGTEEAKLNVASAEQINDILTGGHLNADSQKEIGNLLLPSSFPSFDDKAKEKQVKKLIKNVATNISKAWLGYKADFSTILNLANVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVNNRHADLAKAMKLTGIKKRSELLDPEELKKAISSLLDDSPEAVEIKQMLEEKTFLPLQRSNNNGVIPNQLHQVELDEIIKKQSKYYPFLAEKNPDESEEAQKKAPTKLDALLTFRVPYYVGPMITKEEQEAQDGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRADFAWLSEEQIKQLCRLRLQGWGRLSDKLLTRLTDADGQNVLERLWNSNDNFVQIVSDPNIKAKIEQENQKLLRDGQSDDAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDIDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDYHHAIDAYLSTIVGNYLYQVYPNLRRMFVYGEFKKFSSNAEESAYDVVRRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGKVDVIRKVLKGLHANADITNLAELGFGTAALGALVSTGGIKISDDAVFIYQSPTGLFERRVKVSDLLK

SEQ ID NO: 29 - protein, 1381 aa, Lactobacillus fermentum 28-3-CHN
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 30 - protein, 1386 aa, Lactobacillus gasseri K7
MTKIKNEYIVGLDIGTNSCGWVAMDFQNTILRMHGKTAIGSHLFDAGNSAADRRAFRTTRRRIKRRKWRLKLLEEIFDPYMTEVDPYFFARLKESGLSPLDKRKNASSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKNVFKINKVKSIHQLLSLKTENKERTKLIKDVSKQIINAILGYKTKFETILLKNISKDEADDWEFKLTDVDADNKFENLIGDLNENEQEILLVIRNLANAITLSNIVEEGKTLSESMIDKYNKHSDDLKLLKQVISDHPDRDKAKKLALAYDLYVNNRHGKLLQAKDVLGSKKTLSKEDFYKEVKKNLDDSKASQEILDAIALDSFMPKQRTNENGVIPYQLHQLELDRIIKNQGKYYPFLKEANPVSSHLKQAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKQELYNNLFKKNSTVTTNKLKSYLKENYNLINVEIKGLADEKKFNSGLTTYNKLRNLKIFDQQIDDLNYDKDFERIIEWSTIFEDKAIYKDKLKTIKWLSDRQIDKLSKIRMQGWGQLSKKLLSQLTDNNGQTIIEQLWDSQNNFMQIVNQADFKDAIAVANQNLLVNTSVEDILNEAYTSPANKKAIRQVVKVVDDIVKAASGKVPKQIAIEFTRDADDKAKISQTRANKLRKVYKELSNELASEAIRNELERVAKDQKLLKDKYYLYFMQLGRDAYTGEPIDIDELEQYDIDHILPQSFIKDDSLENRVLVKKAVNNGKSDNVPVKLYGNHMAADLGITIRHMWEKWKDQGLITKTKYNNLIIDPDKINKYESSGFIHRQLVETSQIIKLASTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKGNDIISLETKKKVFDKKDIIEKLKHAYDYKYMLVSRETETRDQEMFKMTVYPRLSRDTKKSRNLIPKKKDMPTEIYGGYTNNSDAYMVIARINKKKETEYRVFGVPMRELVNLRKAEKKGHYNAYLKQVLEPEIMYNKNGKKNKTISSFEIVKSKVPYKQVILDGDKKFMLGSSTYVYNAKQLTLSQDAMQAITDNCENDTDEEKALIEAYDEILTNIDKYLPLFDINKFRDKLHAGREKFINLSLDVKKDTILQVLNGLHDNAVMPKIKSLGLSTELGKLQIPTGVKLSENAKLIYQSPTGLFEKRVKISDL

SEQ ID NO: 31 - protein, 1386 aa, Lactobacillus hominis CRBIP
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 32 - protein, 1395 aa, Lactobacillus jensenii 115-3-CHN
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 33 - protein, 1375 aa, Lactobacillus johnsonii DPC 6026
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 34 - protein, 1382 aa, Lactobacillus mucosae LM1
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 35 - protein, 1348 aa, Lactobacillus otakiensis JCM 15040
MGEDGKPLRVKGKTAIGARLFQEGNPAADRRMFRTTRRRLNRRKWRLKLLDEIFDPYITPVDSTFFARLKQSNLSPKDSRKEFKGSMLFPDLTDKQYHLDYPTIYHLRHALMTQDKQFDIRMVYLAIHHIVKYRGNFLNSTPVDSFKASKVNFDDQFKKLNELYTAINPEESFQINLANSEKIGQQFLDPSIRKFDKKKQIPKIVPVTMDDKAVDKLNGKIASEIINAILGYKSKLDVAVQCDPEDSNPWAVKFDDEDIDAKLQKILPEMDENQQSIIGIIQDLYSQVTLNQIVPNGMSLSESMIKKYNDHHDHLKLYKKLIGQISDSKKKTALKKAYDQYVGNDGKVIEQDDFYSSVKKNLDDSELSKQIMDLIDADKFMPKQRTSQNGVIPHQLHQRELDEIIEHQSKYYPWLAESNPNKHDLHLAKYKIEELVAFRIPYYVGPMITPEDQKKSGAAVFSWMKRKEPGQITPWNFDEKVDRMESANKFIKRMTTKDTYLIGEDVLPDESLLYEKFKVLNELNMVRVNGDSLKVADKQAIYQDLFENYKHISVKKLQNYIKGKTGLPNNPEISGLSDPDQFNNSLGTYNDFKKLFGDKVDDPDLQNDFEKIVEWSTVFEDKKILRAKLNEITWLTDKQKDDLESSRYQGWGRLSKKLLTGIVNDQGERIIDELWNTNKNFMQIQSDDDFAKRIHEANADQMKSTNMEDVLADAYTSPQNKKAIRQVVKVVDDIQKAMGGVAPKFISIEFTRSEDRNPRRTISRQRQLENTLKDTAKSLVKSMNPNILSELDNASRSKKGLTDRLYLYFTQLGKDMYTGEPINIDEISNYDIDHILPQAFIKDDSLSNRVLVSKAVNNGKSANVPLKLFGAKMGHFWKQLAEAGLINKHKLKNLQTNPDTISKFAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQARIADTETGEVIWDRETSIKQLRDVYHYKFMLISQEVYTLRGAMFNQTIYPASQAGRKKLIPMKADKPVDVYGGYSGSTDAYMAIVRIHDKKGDKYKVVGVPMRALNRLNTAKNVSDAKYDQELKEVLTPQFTKSKKNRKTGEITQTVEDFEVVLGKVMYRQLVIDGDKKFMLGSSTYQYNAKQLVLSDESIKTLASEGKLNEAQESAAYDKVYDEILDKVNKYFALYDTNKFRQKLSLGKDKFVGLPNHNVFDGSKKISSGKREILNEILNGLHANATLGTLSDIGFSTPFGKMQQPRGIGLSSNTSIEYESFTGLFKRTIFLKDL

SEQ ID NO: 36 - protein, 1362 aa, Lactobacillus paracasei subsp. Paracasei 8700:2; identical to SEQ ID NO: 25

SEQ ID NO: 37 - protein, 1362 aa, Lactobacillus paracasei subsp. Tolerans Lpl7
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKSRYKYEKRLFNDRTDAEFYKYENCPTMYHLRNRLMTDPSKADVREIYFAIHHILKSRGHFLTPGDAKDFNTNKVAVNKIFPALQDAYAQVYPDLDITFDENKVNEFKTVLLNEKATPSDTQRALVNLLLAKEGDRDILKQQKQALTEFAKAVVGLKTKLNVALGTEVDSSEATAWNFSLGQLDDKWTGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIENIIAWSTIFEDKAIFKTKLNEISWLNAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGKPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 38 - protein, 1382 aa, Lactobacillus pentosus IG1
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 39 - protein, 1361 aa, Lactobacillus pentosus KCA1
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 40 - protein, 1358 aa, Lactobacillus plantarum EGD-AQ4
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 41 - protein, 1368 aa, Lactobacillus reuteri mlc3
MIKKDYNIGLDIGATSVGFAGIDEQYDPIKLKGKTVVGVNLFEEGQTAADRRSFRTTRRRLNRRKWRLSLLEEFFDPYITPVDPAFFARLKESNLSPKDNNKNFSRSLLFPDITDQKFYEEYPTIYHLRYALMTENKKFDLRAIFLAIHHMIKYRGNFLNSTPVAHFDTSKIDFANDFSKLNRLYLNEDPNNIFEINLQNVKEISDILLDHSIKKFDKQKQVAKLLLTSQNDKELDKRNKQIATQISKAILGYNFSLNEILKLEAVNKSKWKLNFSSADIDDTLPDLISELDESQESILNIILSLYSRLTLNGIVPSGMSLSESMIDKYGTHKEHLDLLKKYLKTLPIKNRKEIAEAYAEYVGNSLKKSGHISQEEFYKAVKKNLDKSETAQKILSLISEEKFMPKQRTNQNGVIPYQLHQKELDQIIVNQSQYYPWLAELNPVTEHKDAKYKLDELIAFRVPYYVGPLIDPKTIPQTEQGNKNASFAWMVRKENGQITPWNFDKKVDRISSANNFIKRMTTKDTYLIGEDVLPAHSLIYERFKVLNELNMIRVNGKKLSVSVKQNLYNDLFKQQKTINRKKLANYLQANLGIPERPQITGLSDPEKFNSQLSSYIDLQKILGSEIVDDPNKQDDLEKIIEWSTVFEDSRIYKVKLQEIGWFTEKQKNELVSHRYQGWGRLSKKLLVELKDKNGRSIIDLLWNSQRTFMEIQSRPEFAEQITNENQDKLTEDNYEDVLADAYTSPQNKKAIRQVIKVVDDIVKATGKAPKFISLEFARSDERSDRVKSRKTHIQKIYETTAKELLKDDQLIKELGSVSDLSDRLYLYFTQLGRDMYTGKPINIDEISTMYDIDHILPQAFLKDDSLDNRVLVRRQDNNAKSDTVPALKFGKMKPFWNKLQKHGLISKRKLNNLQTNPESIDKFKAVGFVNRQLVETRQVIKLAANILASRYPDSKIIEVKASLTHQMRESFNLIKNRDVNDYHHAVDAYLSAFVGQYLYNRYPKLQPYFVYGQFKKFDKQSTRIGMKTNHFNFLYDLEPEGKNVKIKKPTKIINKETGEIIGDRDELVAKLNRVYNFKYMLVSQEVYTRSGALFDQTIYPANSGKKLIPLKQNKTTAIYGGYSGSKAAYMSIIRLRDKKGGTYRIVGIPVRAVNKLNQAKKKSNEKYLAELKAVIEPQIAKTKKDRKTGQRVLVPQEFDVIIPEVMYRQLIVDGDQKFTLGGTIDRYNAVQLVLNQEILTFLEQPTKYKDADTKLLDIYDQIVNLVEKYFMLFDSKRLAAGRVAFEKLPTLQPVDKMPSKLIIIRRIIQGLHDNAARTDLKAINGSSSFGRLQKRNGIILSPNACLIYQSPTGLFERKVYLNTISPLK

SEQ ID NO: 42 - protein, 1361 aa, Lactobacillus rhamnosus GG
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 43 - protein, 1369 aa, Lactobacillus rossiae DSM 15814
MDKSKPYGIGLDIGTNSVGFVATDAEGHLIRLKGKTVIGAYLFNAGISAAERRGFRTTRRRLSRVKWRLGLLREIFETHFQESMGENEDNDFFLRFKYSNISPKDPQFSTAKGLFNDRTDKEFYDQYPTIYHLRRALMTEDHQFDIREIYIAMHHIVKYRGHFLKEGRAKDFKVGDLRLLDNFKMMNEQIEEINPLWQLKLPTDDASIKSITAILLDNTQSQNDRQKAVTKVILATLVKASDKDINAARKRFVGELSKAMVGLKTKLWVLADVSQNGDWEIKYENYADFAETIGSGESDTIQSLFNEINDLYGVITLAGIIPKEAESFSDGMVRKYEHHRKNLELLKVYCAEQSDGKRGRQIRQTYDKYIDGVDSKQFTQEDFYKALSKFTAKDEATSENAKLIAQEIAVGTFMPKLRTKANGTIPHQLHQKELDAIIENQKKYYPWLGEVNPVESHRRALPYKLDELVSFRIPYYVGPMVTPTKGDPEKSKFAWMVRKEPGTITPWNFDQKVDRSASGEAFIQRMKTTDTFLIGEDVLPQQSLLYQKFEVLNELNKIMINGKPICREQKQRLFKQLFMQYKTVTVKKVQQNLIANGEESENVPITGLSDPLRFNSSFSTYIDYKDILGTAAVNDNAKQSDIEQIIAWSTIFEDAAIFREKLNDITWLNDDQRNKLSHKRYRGWGRHSRKLLAGLRDGEGQTIIERLWNTNDNFMQIQNDSEIARQITEANSSKMATAEGTDEIIDGFYTSPENKKALREVMKVVKDIQRAHHGQAPAWVYIESPRETPRPGQRTVSREQQLTDLYEGAAKEIVDDAVLNELKDKVKSKENFTDKLVLYFLQNGHDIYANDSINIDNLNAYDIDHVLPQSLIKDDSLDNRVLTTHERNLKKSNRFATELFADQRKKWEKWHRLGLISSRKLKHLTMQPNSVEKFAHGFIARQLTETRQIIHLTANVLSNLYQENDTKIVMIKAGLNSEFRRTFDFPKNRSVNDYHHAFDAFLTAKIGRYLLARYPKLEPFFVYGNFVKNPKAMKRLSSFDFIAQLAAKTDDTSHIDQRSLKQVPVVNEETGEIVWDKDIELAELDKTYNYKTMLVKRAQTENNAQMFKQTVFKARDNQNKTLIPVKNGLSTDVYGGHSQQAISYLCIVWVGQKKKYRVLGISTAHAGILNNFEKNYGRFEAKKKLQEIVSNTLDNADRNDFKIVAPKVLFEQVVEDDNMKFGLGSASDYRNVQQLFLSRKNQLLLANMMTDQIHDQDLVHLFDEIVGQMNAHFPIFDRGGYRSSLTQSRDKFLKLPFKKNEDLITKQEVIRRILDGLHANANRKDLKIIGSKGDFGRLGTKKIYLSKDAKLIYTSPTCLFTRTVPLSSL

SEQ ID NO: 44 - protein, 1375 aa, Lactobacillus ruminis ATCC 25644
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 45 - protein, 1339 aa, Lactobacillus salivarius SMXD57 or UCC118
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 46 - protein, 1331 aa, Lactobacillus sanfranciscensis TMW 1.1304
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 47 - protein, 1371 aa, Lactobacillus buchneri CD034
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 48 - protein, 1314 aa, Lactobacillus animalis KCTC 3501
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 49 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 50 - protein, 1371 aa, Lactobacillus buchneri NRRL B-30929; identical to SEQ ID NO: 47

SEQ ID NO: 51 - protein, 1125 aa, Streptococcus intermedius B196
MNGLVLGLDIGIASVGVGILNKETGEIIHVNSRIFPAATADSNVERRGFRQGRRLGRRKKHRSARLNDLFEEFGFITDFSAVPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLRPEQKRQIVEYARTAKTLGTPTLLKYIAKLVDGSIDDIKGYRIDKSDKPEMHTFDAYRKMRTLELVDVDILSRETLDDLAYILTLNTESEGILEALNSKMPGTFTKEQIDELIQFRKKNSAVFGKGWHNFSLKLMNELIPELYETSEEQMTILTRLGKQRSREISKRTKYIDEKELTDEIYNPVVAKSVRQAIKIINLATKKYGIFDNIVIEMARESNEDDEKKAIQNVQKANEDEKKAAMEKAADLYNGKKELPDSIFHGHKELATKIRLWHQQGERCLYTGKNISIHDLIHNPHQYEIDHILPLSLSFDDGLANKVLVLATANQEKGQRTPFQALDSMDDAWSYIEFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYREGQLVDPETGEILSLTDDEYKELVLRPPYDYFVDTLKSKSFEDSILFSYQVDSKYNRKISDATIYGTRKAQLGKDKQEETYVLGKIKDIYSQKGYEDFIKRYKKDTTQFLMYHKDPQTFAKVIEEILKTYPDKELNEKGKEIPCNPFEKYRQENGPIRKYSKKGKGPEIKSLKYYDNKLGNHIDITPVNSQNQVVLQSLKPWRTDVYFNPQTSKYELMGLKYSDLRFEKGSGSYGISPEKYNKVKAKEGVDEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKI

SEQ ID NO: 52 - protein, 866 aa, Lactobacillus crispatus FB049-03
MGATQQINNIIIDIDVQGEKMGWRNVIITQHAKLTYSMNMLIVQTKDGINQIPIEDINLVLISTSQAVITSALISKLAKNQCKVIFVDDKYQPVTETVNYYPGARDIKKLKMQFEWNERRKENLWTKIVAAKLKNQISVLKNYRIDETEVEQELYKLEVNDLSNREAAAARKYFMKLFGKDFIRRNSGVINAALDYGYSILLSSFDREIAMNGYLTYLGIHHHSVENQFNLACDLMEPFRSIVDYWVKAHENITSFTPDIKYGLVELLSLQIKFNGRNTILTNAISVYVRSCLRYLSGETDDIRIEMSLCNEVPNDAINDNVKYYLYFMQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 53 - protein, 1239 aa, Lactobacillus buchneri ATCC 11577
MTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 54 - RNA, 34 nt, Streptococcus thermophilus
guuuuagagcuguguuguuucgaaugguuccaaa

SEQ ID NO: 55 - RNA, 88 nt, Streptococcus thermophilus
uuugaaaccauucgaaacaacacagcuaucaaaaauaaggcuuaguccguacucaacuucuuuagguggcaccgauucgguguuuuuu

SEQ ID NO: 56 - RNA, 36 nt, Lactobacillus buchneri
guuuuagaaggauguuaaaucaauaagguuaaaccc

SEQ ID NO: 57 - RNA, 139 nt, Lactobacillus buchneri
auguuugaccuuauugauuuaacauccuguguuaaaaucaagcaaagcgcuuugcgcggaguuucaacuuuugacccauuauaugggcauuacauaagcgaaaggaaccauucuucaguuggagaaugguuccuuuuuu

SEQ ID NO: 58 - RNA, 31 nt, Streptococcus thermophilus
guuuuuguacucucaagauuuaaguaacugu

SEQ ID NO: 59 - RNA, 88 nt, Streptococcus thermophilus
acaguuacuuaaaucuugcagaagcuacaaagauaaggcuucaugccgaaaucaacacccugucauuuuauggcaggguguuuucguu

SEQ ID NO: 60 - RNA, 33 nt, Streptococcus pyogenes
guuuuagagcuaugcuguuuugaauggucccaa

SEQ ID NO: 61 - RNA, 88 nt, Streptococcus pyogenes
uuggaaccauucaaaacagcauagcaaagcaaaaauaaggcuaguccguuaucaacuucuuuaaguggcaccgagucggugguuuuuu

SEQ ID NO: 62 - RNA, 36 nt, Lactobacillus rhamnosus
gucucagguagaugucagaucaaucaguucaagagc

SEQ ID NO: 63 - RNA, 110 nt, Lactobacillus rhamnosus
caacuugaauugauugaucugacaucuacgaguugagaucaaacaaagcuucagcugaguuucaauuucugagcccauguugggccauacauaugccacccgagugcaaa

SEQ ID NO: 64 - RNA, 36 nt, Lactobacillus animalis
guuuuagagcuauguuguuuuguaugacuccaaaac

SEQ ID NO: 65 - RNA, 104 nt, Lactobacillus animalis
cuaguggaguuauacaaaacaacauuagcgaaguuaaaauaagguuuaauccguaaucaacaaguuuuaucuugcgcgcgccguuucggcgcuuuuuuuguuuu

SEQ ID NO: 66 - RNA, 36 nt, Lactobacillus casei
gcucuugaacugauugauucgacaucuaccugagac

SEQ ID NO: 67 - RNA, 109 nt, Lactobacillus casei
cguuuugaacugauugauucgacaucuacacguugagaucaaacaaagccucggcugaguuucaauuucugagcccauguugggccauacauaccgccauccgggaaaa

SEQ ID NO: 68 - RNA, 36 nt, Lactobacillus gasseri
guuuuagaugguuguuagaucaauaaggcuuagauc

SEQ ID NO: 69 - RNA, 112 nt, Lactobacillus gasseri
acacuaaacuuuauugaucuaacaaccagauuuaaaaucaagcaaugcaucuuuugaugcaaaguuucaauacuugucccgagcuaucgagggacuuuuuuuaugcaaaaaa

SEQ ID NO: 70 - RNA, 36 nt, Lactobacillus jensenii
guuuuagaagguuguuaaaucaguaaguugaaaaac

SEQ ID NO: 71 - RNA, 115 nt, Lactobacillus jensenii
acauuucaauuuacugauuuaacaaccuuauuuuuaaaaucaagcaaggcuuucgggccgaguuuucacauguguaccgcuuauagcggucuuuuuuuuugcaguaaauaaaaaa

SEQ ID NO: 72 - RNA, 36 nt, Lactobacillus pentosus
gucuugaauaguagucauaucaaacagguuuagaac

SEQ ID NO: 73 - RNA, 117 nt, Lactobacillus pentosus
guucuaaaccuucuugauaugacuacuagcgucaagaucaaacaaggcauuuugccgaguuucaccuuuugaguccguauucggaccauuacauauguaucaagaugucgcccauuu

SEQ ID NO: 74 - DNA, 10 bp, Artificial Sequence
  Synthetic trans-encoded CRISPR sequence
gataaggctt

SEQ ID NO: 75 - DNA, 14 bp, Artificial Sequence
  Synthetic trans-encoded CRISPR sequence
gataaggccatgcc

SEQ ID NO: 76 - DNA, 12 bp, Artificial Sequence
  Synthetic trans-encoded CRISPR sequence
taaggctagtcc

SEQ ID NO: 77 - DNA, 11 bp, Artificial Sequence
  Synthetic trans-encoded CRISPR sequence
tcaagcaaagc

SEQ ID NO: 78 - DNA, 17 bp, Artificial Sequence
  Synthetic trans-encoded CRISPR sequence
tcaaacaaagcttcagc

SEQ ID NO: 79 - RNA, 32 nt, Lactobacillus gasseri
ucaagcaaugcaucuuuugaugcaaaguuuuc

SEQ ID NO: 80 - DNA, 17 bp, Artificial sequence
  Synthetic oligonucleotide
gataaggcttyatgccg

SEQ ID NO: 81 - DNA, 17 bp, Artificial Sequence
  Synthetic oligonucleotide
taaggcwddkhybktwh

SEQ ID NO: 82 - DNA, 11 bp, Artificial Sequence
  Synthetic oligonucleotide
  misc_feature (9)..(9): n is a, c, g, or t
tmaammrwndb

SEQ ID NO: 83 - DNA, 15 bp, Artificial Sequence
  Synthetic oligonucleotide
tcaagcaadrcdyhh

SEQ ID NO: 84 - DNA, 36 bp, Streptococcus thermophilus
gtttttgtactctcaagatttaagtaactgtacaac

SEQ ID NO: 85 - DNA, 36 bp, Streptococcus anginosus
gtttttgtactctcaagatttaagtaactgtaaaac

SEQ ID NO: 86 - DNA, 36 bp, Streptococcus infantarius
gtttttgtactctcaagatttaagtaaccgtaaaac

SEQ ID NO: 87 - DNA, 36 bp, Streptococcus intermedius
gtttttgtactctcaagatttaagtaactgcaaaac

SEQ ID NO: 88 - DNA, 36 bp, Lactobacillus rossiae
gttttagatgtatgtcagatcaatagggttaagaac

SEQ ID NO: 89 - DNA, 36 bp, Streptococcus mutans
gttttagagctgtgttgtttcgaatggttccaaaac

SEQ ID NO: 90 - DNA, 36 bp, Streptococcus agalactiae
gttttagagctgtgctgtttcgaatggttccaaaac

SEQ ID NO: 91 - DNA, 36 bp, Streptococcus pyogenes
gttttagagctatgctgttttgaatggtcccaaaac

SEQ ID NO: 92 - DNA, 36 bp, Streptococcus dysgalactiae
gttttagagctatgttgttttgaatggtcccaaaac

SEQ ID NO: 93 - DNA, 36 bp, Streptococcus equi
gttttagagttatgctgtattgaatggttccaaaac

SEQ ID NO: 94 - DNA, 36 bp, Lactobacillus buchneri
gctttagtagtagttcaaaacaatgatgttttatcc

SEQ ID NO: 95 - DNA, 36 bp, Lactobacillus mucosae
gctttagatggatgttaaatcaatgatgtaattctc

SEQ ID NO: 96 - DNA, 36 bp, Lactobacillus brevis
gctttagtaggatgttaaatcaatgatgttaaaccc

SEQ ID NO: 97 - DNA, 36 bp, Lactobacillus casei
gtctcaggtagatgtcgaatcaatcagttcaagagc

SEQ ID NO: 98 - DNA, 36 bp, Lactobacillus rhamnosus
gtctcaggtagatgtcagatcaatcagttcaagagc

SEQ ID NO: 99 - DNA, 36 bp, Lactobacillus pentosus
gtcttgaatagtagtcatatcaaacaggtttagaac

SEQ ID NO: 100 - DNA, 36 bp, Lactobacillus fermentum
gtcttggatgagtgtcagatcagtagttccgagtac

SEQ ID NO: 101 - DNA, 36 bp, Lactobacillus reuteri
gttttagatgtacttcaaatcaataatgtttagaac

SEQ ID NO: 102 - DNA, 35 bp, Lactobacillus sanfranciscensis
gttttagaagtacgtcattctaatgagattaagag

SEQ ID NO: 103 - DNA, 36 bp, Lactobacillus ruminis
gtttcagctggatgtcatatcaatgatgttatgaac

SEQ ID NO: 104 - DNA, 36 bp, Lactobacillus coryniformis
gttttagaagagtgttaaatcaatgagtttagaacc

SEQ ID NO: 105 - DNA, 36 bp, Lactobacillus curvatus
gttttagaagagtatcaaatcaatgagtagttcaac

SEQ ID NO: 106 - DNA, 36 bp, Lactobacillus gasseri
gttttagatggttgttagatcaataaggcttagatc

SEQ ID NO: 107 - DNA, 36 bp, Lactobacillus johnsonii
gttttagatggttgttagatcaataaggtttagatc

SEQ ID NO: 108 - DNA, 36 bp, Lactobacillus hominis
gttttagttagttgttagatcaataaggtttagatc

SEQ ID NO: 109 - DNA, 36 bp, Lactobacillus crispatus
gttttagatgattgttagatcaatgaggtttagatc

SEQ ID NO: 110 - DNA, 36 bp, Lactobacillus buchneri
gttttagaaggatgttaaatcaataaggttaaaccc

SEQ ID NO: 111 - DNA, 36 bp, Lactobacillus pentosus
gtttcagaaggacattaaatcaataaggtcaagacc

SEQ ID NO: 112 - DNA, 36 bp, Lactobacillus salivarius
gtttcagaagtatgttaaatcaataaggttaagacc

SEQ ID NO: 113 - DNA, 36 bp, Lactobacillus delbrueckii
gttttagaaggttgtctattcaataaggtttaaccc

SEQ ID NO: 114 - DNA, 20 bp, Streptococcus thermophilus
aagctacaaagataaggctt

SEQ ID NO: 115 - DNA, 20 bp, Streptococcus orisratti
agcctacaaagataaggctt

SEQ ID NO: 116 - DNA, 17 bp, Lactobacillus animalis
aagttaaaataaggttt

SEQ ID NO: 117 - DNA, 15 bp, Streptococcus intermedius
aagttaaaataaggc

SEQ ID NO: 118 - DNA, 15 bp, Streptococcus thermophilus
cagttaaaataaggc

SEQ ID NO: 119 - DNA, 15 bp, Streptococcus agalactiae
gcgttaaaataaggc

SEQ ID NO: 120 - DNA, 15 bp, Streptococcus gallolyticus
gagttaaaataaggc

SEQ ID NO: 121 - DNA, 17 bp, Lactobacillus brevis
ggtttaaagtcaaacaa

SEQ ID NO: 122 - DNA, 16 bp, Lactobacillus farciminis
agattaaaataaacaa

SEQ ID NO: 123 - DNA, 17 bp, Lactobacillus casei
acgttgagatcaaacaa

SEQ ID NO: 124 - DNA, 17 bp, Lactobacillus rhamnosus
gagttgagatcaaacaa

SEQ ID NO: 125 - DNA, 17 bp, Lactobacillus salivarius
gagttgaaatcaaacaa

SEQ ID NO: 126 - DNA, 17 bp, Lactobacillus pentosus
tatttgaaatcaaacaa

SEQ ID NO: 127 - DNA, 17 bp, Lactobacillus coryniformis
gagttaaaatcaaacaa

SEQ ID NO: 128 - DNA, 17 bp, Lactobacillus mucosae
gagttaaagtcaaacaa

SEQ ID NO: 129 - DNA, 17 bp, Lactobacillus pentosus
gcgtcaagatcaaacaa

SEQ ID NO: 130 - DNA, 17 bp, Lactobacillus fermentum
tagtcaagatcaaacga

SEQ ID NO: 131 - DNA, 17 bp, Lactobacillus buchneri
gtgttaaaatcaagcaa

SEQ ID NO: 132 - DNA, 17 bp, Lactobacillus rossiae
gcgttaaaatcaagcaa

SEQ ID NO: 133 - DNA, 17 bp, Lactobacillus delbrueckii
gatttaaaatcaagcaa

SEQ ID NO: 134 - DNA, 18 bp, Lactobacillus jensenii
atttttaaaatcaagcaa

SEQ ID NO: 135 - DNA, 17 bp, Lactobacillus crispatus
aatttaaaatcaagcaa

SEQ ID NO: 136 - DNA, 17 bp, Lactobacillus ruminis
aagttgaaatcaagcaa

SEQ ID NO: 137 - RNA, 64 nt, Streptococcus thermophilus
uguaagugcgcauugcuuuaaaaauggcaaguuuuagagcuguguuguuucgaaugguuccaaa

SEQ ID NO: 138 - DNA, 49 bp, Artificial Sequence
  Synthetic oligonucleotide
  misc_feature (2)..(2): n is a, c, g, or t
  misc_feature (5)..(5): n is a, c, g, or t
cnccnttgccatttttaaagcaatgcgcacttacacacaacaactaaag

SEQ ID NO: 139 - DNA, 49 bp, Artificial Sequence
  Synthetic oligonucleotide
  misc_feature (45)..(45): n is a, c, g, or t
  misc_feature (48)..(48): n is a, c, g, or t
ctttagttgttgtgtgtaagtgcgcattgctttaaaaatggcaanggng

SEQ ID NO: 140 - RNA, 137 nt, Lactobacillus buchneri
guuugaccuuauugauuuaacauccuguguugaaaucaagcaaagcgcuuugcgcggaguuucaacuuuugacccauuauaugggcauuacauaagcgaaaggaaccauucuucaguuggagaaugguuccuuuuuu

SEQ ID NO: 141 - DNA, 64 bp, Lactobacillus buchneri
gaggtgactgtcggagagagggaggatgcaguuuuagaaggauguuaaaucaauaagguuaaac

SEQ ID NO: 142 - DNA, 36 bp, Artificial Sequence
  Synthetic oligonucleotide
  misc_feature (5)..(6): n is a, c, g, or t
ttttnntgtatcctcactctctccgacagtcacctc

SEQ ID NO: 143 - DNA, 36 bp, Artificial Sequence
  Synthetic oligonucleotide
  misc_feature (31)..(32): n is a, c, g, or t
gaggtgactgtcggagagagtgaggatacannaaaa

SEQ ID NO: 144 - RNA, 61 nt, Streptococcus thermophilus
uguaagugcgcauugcuuuaaaaauggcaaguuuuuguacucucaagauuuaaguaacugu

SEQ ID NO: 145 - DNA, 51 bp, Artificial Sequence
  Synthetic oligonucleotide
  misc_feature (6)..(7): n is a, c, g, or t
wttctnnttgccatttttaaagcaatgcgcacttacacacaacaactaaag

SEQ ID NO: 146 - DNA, 51 bp, Artificial Sequence
  Synthetic oligonucleotide
  misc_feature (45)..(46): n is a, c, g, or t
ctttagttgttgtgtgtaagtgcgcattgctttaaaaatggcaannagaaw

SEQ ID NO: 147 - RNA, 63 nt, Streptococcus pyogenes
uguaagugcgcauugcuuuaaaaauggcaaguuuuagagcuaugcuguuuugaauggucccaa

SEQ ID NO: 148 - DNA, 47 bp, Artificial Sequence
  Synthetic oligonucleotide
  misc_feature (3)..(3): n is a, c, g, or t
ccnttgccatttttaaagcaatgcgcacttacacacaacaactaaag

SEQ ID NO: 149 - DNA, 47 bp, Artificial Sequence
  Synthetic oligonucleotide
  misc_feature (45)..(45): n is a, c, g, or t
ctttagttgttgtgtgtaagtgcgcattgctttaaaaatggcaangg

SEQ ID NO: 150 - RNA, 91 nt, Lactobacillus rhamnosus
cuugaauugauugaucugacaucuacgaguugagaucaaacaaagcuucagcugaguuucaauuucugagcccauguugggccauacauau

SEQ ID NO: 151 - RNA, 63 nt, Lactobacillus rhamnosus
cgagcuugcggccaauaucaagcuauaugcgucucagguagaugucagaucaaucaguucaag

SEQ ID NO: 152 - DNA, 71 bp, Artificial Sequence
  Synthetic oligonucleotide
agtgattacaagtccacggtatttttcggcatatagcttgatattggccgcaagctcgttagagtcagcac

SEQ ID NO: 153 - DNA, 71 bp, Artificial Sequence
  Synthetic oligonucleotide
gtgctgactctaacgagcttgcggccaatatcaagctatatgccgaaaaataccgtggacttgtaatcact

SEQ ID NO: 154 - RNA, 100 nt, Lactobacillus animalis
uggaguuauacaaaacaacauuagcgaaguuuuaauaagguuuaauuuguaaucaacaaguuuuaucuuucgugcgccguuucggcgcuuuuuuuguuuu

SEQ ID NO: 155 - DNA, 62 bp, Lactobacillus animalis
ataccgtggagatttgattaactggtatacguuuuagagcuauguuguuuuguaugacucca

SEQ ID NO: 156 - DNA, 71 bp, Artificial Sequence
  Synthetic oligonucleotide
tgcagcttgagttactgtcttgttgcaagtataccagttaatcaaatctccacggtattgttggtaatcag

SEQ ID NO: 157 - DNA, 71 bp, Artificial Sequence
  Synthetic oligonucleotide
ctgattaccaacaataccgtggagatttgattaactggtatacttgcaacaagacagtaactcaagctgca

SEQ ID NO: 158 - RNA, 105 nt, Lactobacillus casei
uuugaacugauugauucgacaucuacacguugagaucaaacaaagccucggcugaguuucaauuucugagcccauguugggccauacauaccgccauccgggaaa

SEQ ID NO: 159 - RNA, 63 nt, Lactobacillus casei
uguaagugcgcauugcuuuaaaaauggcaagucucagguagaugucgaaucaaucaguucaag

SEQ ID NO: 160 - DNA, 73 bp, Artificial Sequence
  Synthetic oligonucleotide
gcctttgacattttctttggattttttcattgccatttttaaagcaatgcgcacttacacacaacaactaaag

SEQ ID NO: 161 - DNA, 73 bp, Artificial Sequence
  Synthetic oligonucleotide
ctttagttgttgtgtgtaagtgcgcattgctttaaaaatggcaatgaaaaaatccaaagaaaatgtcaaaggc

SEQ ID NO: 162 - RNA, 110 nt, Lactobacillus gasseri
cuaaacuuuauugaucuaacaaccagauuuaaaauucaagcaaugcaucuuuugaugcaaaguuuucacaugugucccgagcuaucgagggacuuuuuuuaugcaaaaaa

SEQ ID NO: 163 - RNA, 63 nt, Lactobacillus gasseri
auaccguggagauuugauuaacugguauacguuuuagaugguuguuagaucaauaaggcuuag

SEQ ID NO: 164 - DNA, 72 bp, Artificial Sequence
  Synthetic oligonucleotide
tgcagcttgagttactgtcttgttgttaagtataccagttaatcaaatctccacggtattgttggtaatcag

SEQ ID NO: 165 - DNA, 72 bp, Artificial Sequence
  Synthetic oligonucleotide
ctgattaccaacaataccgtggagatttgattaactggtatacttaacaacaagacagtaactcaagctgca

SEQ ID NO: 166 - RNA, 96 nt, Lactobacillus jensenii
auuucaauuuacugauuuaacaaccuuauuuuuaaaucaagcaaggcuuucgggccgaguuuucacauguguaccgcuuauagcgguuuuuuuuuu

SEQ ID NO: 167 - DNA, 63 bp, Lactobacillus jensenii
ataccgtggagatttgattaactggtatacguuuugaagguuguuaaaucaguaaguugaaaa

SEQ ID NO: 168 - DNA, 71 bp, Artificial Sequence
  Synthetic oligonucleotide
tgcagcttgagttactgtcttgttgccagtataccagttaatcaaatctccacggtattgttggtaatcag

SEQ ID NO: 169 - DNA, 71 bp, Artificial Sequence
  Synthetic oligonucleotide
ctgattaccaacaataccgtggagatttgattaactggtatactggcaacaagacagtaactcaagctgca

SEQ ID NO: 170 - RNA, 117 nt, Lactobacillus pentosus; identical to SEQ ID NO: 73

SEQ ID NO: 171 - RNA, 66 nt, Lactobacillus pentosus
uguaagugcgcauugcuuuaaaaauggcaagucuugaauaguagucauaucaaacagguuuagaac

SEQ ID NO: 172 - DNA, 47 bp, Artificial Sequence
  Synthetic oligonucleotide
  misc_feature (2)..(3): n is a, c, g, or t
cnnttgccatttttaaagcaatgcgcacttacacacaacaactaaag

SEQ ID NO: 173 - DNA, 47 bp, Artificial Sequence
  Synthetic oligonucleotide
  misc_feature (45)..(46): n is a, c, g, or t
ctttagttgttgtgtgtaagtgcgcattgctttaaaaatggcaanng

SEQ ID NO: 174 - RNA, 36 nt, Artificial Sequence
  Synthetic oligonucleotide
acaryryagyraaguuaaaauaaggcuuwguccguw

SEQ ID NO: 175 - RNA, 25 nt, Artificial Sequence
  Synthetic oligonucleotide
wcaacuurwraargkgmgcacccga

SEQ ID NO: 176 - RNA, 18 nt, Artificial Sequence
  Synthetic oligonucleotide
guuuuagagyurugyugu

SEQ ID NO: 177 - RNA, 49 nt, Artificial Sequence
  Synthetic oligonucleotide
aaucuugcwgarscuacaaagauaaggcuucaugccgaawucaagcacc

SEQ ID NO: 178 - RNA, 20 nt, Artificial Sequence
  Synthetic oligonucleotide
guuuuuguacucucaagauu

SEQ ID NO: 179 - RNA, 17 nt, Artificial Sequence
  Synthetic oligonucleotide
kuuuyrarrucaarcra

SEQ ID NO: 180 - RNA, 10 nt, Artificial Sequence
  Synthetic oligonucleotide
gyyyurrrwr

SEQ ID NO: 181 - RNA, 13 nt, Streptococcus pyogenes
aaggcuaguccgu

SEQ ID NO: 182 - RNA, 14 nt, Streptococcus equi
aaggcuuuguccgu

SEQ ID NO: 183 - RNA, 14 nt, Streptococcus thermophilus
aaggcuuaguccgu

SEQ ID NO: 184 - RNA, 14 nt, Streptococcus mutans
aaggcuucaugccg

SEQ ID NO: 185 - RNA, 25 nt, Lactobacillus brevis
caaacaaggcaguaaugccaaguuc

SEQ ID NO: 186 - RNA, 25 nt, Lactobacillus buchneri
caaacaagguagcaauaccaaguuc

SEQ ID NO: 187 - RNA, 24 nt, Lactobacillus mucosae
caaacaaugcauucugcaaaguua

SEQ ID NO: 188 - RNA, 25 nt, Lactobacillus curvatus
caaacaaggucuucggaccaaguuu

SEQ ID NO: 189 - RNA, 25 nt, Lactobacillus fermentum
caaacgagugguuuuccacgaguua

SEQ ID NO: 190 - RNA, 25 nt, Lactobacillus reuteri
caaacaagugcuucagcacaaguuu

SEQ ID NO: 191 - RNA, 24 nt, Lactobacillus plantarum
caaacaaggcauuuugccaaguuu

SEQ ID NO: 192 - RNA, 24 nt, Lactobacillus pentosus
caaacaaggcauuuugccgaguuu

SEQ ID NO: 193 - RNA, 23 nt, Lactobacillus coryniformis
caaacaaggcguaagccaaguuu

SEQ ID NO: 194 - RNA, 26 nt, Lactobacillus buchneri
caagcaaaggcauuugcgcggaguuu

SEQ ID NO: 195 - RNA, 26 nt, Lactobacillus otakiensis
caagcaaugcgcuuugcgcggaguuu

SEQ ID NO: 196 - RNA, 23 nt, Lactobacillus casei
caaacaaagccucggcugaguuu

SEQ ID NO: 197 - RNA, 23 nt, Lactobacillus rhamnosus
caaacaaagcuucagcugaguuu

SEQ ID NO: 198 - RNA, 29 nt, Lactobacillus gasseri
caagcaaugcaucuuuugaugcaaaguuu

SEQ ID NO: 199 - RNA, 25 nt, Lactobacillus jensenii
caagcaaggcuuucgggccgaguuu

SEQ ID NO: 200 - RNA, 27 nt, Lactobacillus delbrueckii
caagcaaagcucuucggagcggaguuu

SEQ ID NO: 201 - RNA, 25 nt, Lactobacillus rossiae
caagcaaggcuuucgagccaaguuu

SEQ ID NO: 202 - DNA, 36 bp, Streptococcus thermophilus; identical to SEQ ID NO: 89

SEQ ID NO: 203 - DNA, 35 bp, Streptococcus gallolyticus
gttttagagctgtgctgtttcgaatggttccaaac

SEQ ID NO: 204 - DNA, 36 bp, Streptococcus equi; identical to SEQ ID NO: 93

SEQ ID NO: 205 - DNA, 36 bp, Streptococcus pyogenes; identical to SEQ ID NO: 91

SEQ ID NO: 206 - DNA, 36 bp, Streptococcus dysgalactiae; identical to SEQ ID NO: 92

SEQ ID NO: 207 - DNA, 36 bp, Streptococcus anginosus; identical to SEQ ID NO: 90

SEQ ID NO: 208 - DNA, 36 bp, Streptococcus infantarius; identical to SEQ ID NO: 86

SEQ ID NO: 209 - DNA, 36 bp, Streptococcus intermedius; identical to SEQ ID NO: 87

SEQ ID NO: 210 - DNA, 36 bp, Streptococcus thermophilus; identical to SEQ ID NO: 84

SEQ ID NO: 211 - DNA, 36 bp, Streptococcus anginosus; identical to SEQ ID NO: 85

SEQ ID NO: 212 - DNA, 36 bp, Lactobacillus fermentum; identical to SEQ ID NO: 100

SEQ ID NO: 213 - DNA, 36 bp, Lactobacillus rhamnosus; identical to SEQ ID NO: 98

SEQ ID NO: 214 - DNA, 36 bp, Lactobacillus casei; identical to SEQ ID NO: 97

SEQ ID NO: 215 - DNA, 36 bp, Lactobacillus pentosus; identical to SEQ ID NO: 99

SEQ ID NO: 216 - DNA, 36 bp, Lactobacillus reuteri; identical to SEQ ID NO: 101

SEQ ID NO: 217 - DNA, 36 bp, Lactobacillus curvatus; identical to SEQ ID NO: 105

SEQ ID NO: 218 - DNA, 36 bp, Lactobacillus buchneri; identical to SEQ ID NO: 94

SEQ ID NO: 219 - DNA, 36 bp, Lactobacillus coryniformis; identical to SEQ ID NO: 104

SEQ ID NO: 220 - DNA, 36 bp, Lactobacillus brevis; identical to SEQ ID NO: 96

SEQ ID NO: 221 - DNA, 36 bp, Lactobacillus mucosae; identical to SEQ ID NO: 95

SEQ ID NO: 222 - DNA, 36 bp, Lactobacillus rossiae; identical to SEQ ID NO: 88

SEQ ID NO: 223 - DNA, 36 bp, Lactobacillus hominis; identical to SEQ ID NO: 108

SEQ ID NO: 224 - DNA, 36 bp, Lactobacillus gasseri; identical to SEQ ID NO: 106

SEQ ID NO: 225 - DNA, 36 bp, Lactobacillus johnsonii; identical to SEQ ID NO: 107

SEQ ID NO: 226 - DNA, 36 bp, Lactobacillus jensenii
gttttagaaggttgttaaatcagtaagttgaaaaac

SEQ ID NO: 227 - DNA, 36 bp, Lactobacillus buchneri; identical to SEQ ID NO: 110

SEQ ID NO: 228 - DNA, 36 bp, Lactobacillus delbrueckii; identical to SEQ ID NO: 113

SEQ ID NO: 229 - RNA, 91 nt, Streptococcus pyogenes
uuguuggaaccauucaaaacagcauagcaaguuaaaauaaggcuaguccguuaucaacuugaaaaaguggcaccgagucggugcuuuuuuu

SEQ ID NO: 230 - RNA, 89 nt, Streptococcus dysgalactiae
uuguuggaaccauucaaaacaacguagcaaguuaaaauaaggcuaguccguuaucaacuugaaaaaguggcaccgagucggugcuuuuu

SEQ ID NO: 231 - RNA, 93 nt, Streptococcus equi
ccuauggaacuauucaauacagcauagcaaaguuaaaauaaggcuuuguccguaaucaaccugaaaaggggagcaccgaaucggugcuuuuuu

SEQ ID NO: 232 - RNA, 91 nt, Streptococcus thermophilus
gguuugaaaccauucgaaacaacacagcgaguuaaaauaaggcuuaguccguacucaacuugaaaagguggcaccgauucggguuuuuuuu

SEQ ID NO: 233 - RNA, 92 nt, Streptococcus salivarius
gguuugaaaccauucgaaacaauacagcaaaguuaaaauaaggcuuaguccguauucaacuugagaaaguggcaccgauucggugcuuuuuu

SEQ ID NO: 234 - RNA, 95 nt, Streptococcus gallolyticus
uuguuggagcuauucgaaacaacacagcgaguuaaaauaaggcuuuguccguacacaacuuguaaaaguggcacccgauucgggugcguuuuuuu

SEQ ID NO: 235 - RNA, 94 nt, Streptococcus lutetiensis
uuguuggaacuauucgaaacaacacagugaguuaaaauaaggcuuuguccguacacaacuuauaaaaguggcacccgauucggaugcauuuuuu

SEQ ID NO: 236 - RNA, 91 nt, Streptococcus anginosus
auguuggaaucauucgaaacaacacagcaaguuaaaauaaggcuuuguccguacucaacuuaaaaagugcgcaccgauucggugcuuuuuu

SEQ ID NO: 237 - RNA, 93 nt, Streptococcus mitis
ucguuggaacuauucgaaacaacacagcaaaguuaaaauaaggcuuuguccguacacaacuugaaaaagugcgcaccgauucggugcuuuuuu

SEQ ID NO: 238 - RNA, 92 nt, Streptococcus sanguis
uuguuggaacuauucgaaacaacacagcaaguuaaaauaaggcuuuguccguacacaacuugaaaaagugcgcaccgauucggugcuuuuuu

SEQ ID NO: 239 - RNA, 91 nt, Streptococcus oralis
uuguuggaacuauucgaaacaacacagcaaguuaaaauaaggcuuuguccguacacaacuugaaaaagugcgcaccgauucggugcuuuuu

SEQ ID NO: 240 - RNA, 90 nt, Streptococcus mutans
cuuacacaguuacuuaaaucuugcagaagcuacaaagauaaggcuucaugccgaaaucaacacccuaucuauuauaagauaggguguuuu

SEQ ID NO: 241 - RNA, 85 nt, Streptococcus intermedius
cuuacacaguuacuuaaaucuugcagaagcuacaaagauaaggcuucaugccgaaaucaacacccugucuaugacgggguguuuu

SEQ ID NO: 242 - RNA, 89 nt, Streptococcus thermophilus
cuuacacaguuacuuaaaucuugcagaagcuacaaagauaaggcuucaugccgaaaucaacacccugucauuuuauggcaggguguuuu

SEQ ID NO: 243 - RNA, 88 nt, Streptococcus gordonii
cuuacacaguuacuuaaaucuugcagaagcuacaaagauaaggcuucaugccgaauucaacacccugucauuuauggcgggguguuuu

SEQ ID NO: 244 - RNA, 86 nt, Streptococcus orisratti
cuugcacaguuacuuaaaucuugcagagccuacaaagauaaggcuuuaugccgaaaucaagcaccccguuuauacgaggugcuuuu

SEQ ID NO: 245 - RNA, 90 nt, Streptococcus henryi
cuugcacaguuacuuaaaucuugcugagccuacaaagauaaggcuucaugccgaaaucaagcacccccguuuuuaacgaggggugcuuuu

SEQ ID NO: 246 - RNA, 88 nt, Streptococcus infantarius
cuugcacgguuacuuaaaucuugcagagccuacaaagauaaggcuucaugccgaauucaagcaccccauguuuacauggggugcuuuu

SEQ ID NO: 247 - DNA, 105 bp, Lactobacillus brevis
ccuguuuaacaucauugauuuaacauccugguuuaaagucaaacaaggcaguaaugccaaguucuuacuuaugacucatacguaugugagcauacauauaaaaaa

SEQ ID NO: 248 - RNA, 102 nt, Lactobacillus buchneri
cggauagacaucauuguuuugaacuacugguuuaaagucaaacaagguagcaauaccaaguucuuacuuaugacccauuuauaugggcauacauacaauaaa

SEQ ID NO: 249 - RNA, 104 nt, Lactobacillus mucosae
aggaauaacaucauugauuuaacauccagaguuaaagucaaacaaugcauucugcaaaguuauuucuucugacccauuuauuaaugggcaauacauauuaaaaa

SEQ ID NO: 250 - RNA, 113 nt, Lactobacillus curvatus
aucgaaauacucauugauuugauacucugaguuaaaaucaaacaaggucuucggaccaaguuuucuauucuaagccucuuaugaggccuuuuuuuaugccuucaaaccaaaaa

SEQ ID NO: 251 - RNA, 113 nt, Lactobacillus fermentum
acauucgagacuacugaucuaacacucauagucaagaucaaacgagugguuuuccacgaguuauuacuuuugagccauguuauucuggccauacauauaauaaaaaaauuaaa

SEQ ID NO: 252 - RNA, 108 nt, Lactobacillus reuteri
cuacuaaauauuauugauuugaaguacagaguuaaaaucaaacaagugcuucagcacaaguuucuacuuuugagucaguuaucugaccaauacauaaaaggguaucaa

SEQ ID NO: 253 - RNA, 117 nt, Lactobacillus plantarum; identical to SEQ ID NO: 73

SEQ ID NO: 254 - RNA, 109 nt, Lactobacillus pentosus
guucuaaaccuucuugauaugacuacuagcgucaagaucaaacaaggcauuuugccgaguuucaccuuuugaguccguauucggaccauuacauaugcuucgugaucaa

SEQ ID NO: 255 - RNA, 100 nt, Lactobacillus coryniformis
cuaucuaaacuuauugauuuaacacucugaguuaaaaucaaacaaggcguaagccaaguuucaccuuuugaguccguauucggaccauuacauaugaaaa

SEQ ID NO: 256 - RNA, 108 nt, Lactobacillus buchneri
auguuugaccuuauugauuuaacauccuguguuaaaaucaagcaaagcgcuuugcgcggaguuucaucuugugagucccuauggaccauaaaggcgcuauugauaaaa

SEQ ID NO: 257 - RNA, 113 nt, Lactobacillus otakiensis
auguuugaccuuauugauuuaacauccuguguuaaaaucaagcaaugcgcuuugcgcggaguuucaauuucugagcccauguugggccauacauaccgccauccgggugcaaa

SEQ ID NO: 258 - RNA, 107 nt, Lactobacillus paracasei
cguuuugaacugauugauucgacaucuacacguugagaucaaacaaagccucggcugaguuucaauuucugagcccauguugggccauacauaccgccauccgggau

SEQ ID NO: 259 - RNA, 135 nt, Lactobacillus casei
cguuuugaacugauugauucgacaucuacacguugagaucaaacaaagccucggcugaguuucaauuucugagcccauguugggccauacauaugccacccgagauucuucgauuuggagaaugguuccuuuuuu

SEQ ID NO: 260 - RNA, 107 nt, Lactobacillus rhamnosus
caacuugaauugauugaucugacaucuacgaguugagaucaaacaaagcuucagcugaguuucaacuuuugacccauuauaugggcauuacauaugcgaaaggaacc

SEQ ID NO: 261 - RNA, 112 nt, Lactobacillus gasseri
acacuaaacuuuauugaucuaacaaccagauuuaaaaucaagcaaugcaucuuuugaugcaaaguuuccacuuuugacccauuauaugggcauuacauaagcuaaaggaacc

SEQ ID NO: 262 - RNA, 112 nt, Lactobacillus hominis
acucuaaacuuuauugaucuaacaaccagauuuaaaaucaagcaaugcaucuuuugaugcaaaguuucaauacuugucccgagcuaucgagggacuuuuuuuaugcaaaaaa

SEQ ID NO: 263 - RNA, 112 nt, Lactobacillus johnsonii
caucuaaacuuuauugaucuaacaaccagauuuaaaaucaagcaaugcaucuuuugaugcaaaguuucaacacuugucccgagcuaucgagggacuuuuuuuauacaaaaaa

SEQ ID NO: 264 - RNA, 100 nt, Lactobacillus jensenii
acauuucaauuuacugauuuaacaaccuuauuuuuaaaaucaagcaaggcuuucgggccgaguuuucacauguguaccgcuuauagcggucuuuuuuuuu

SEQ ID NO: 265 - RNA, 98 nt, Lactobacillus delbrueckii
acguuugaccuuauugaauagacaaccugauuuaaaaucaagcaaagcucuucggagcggaguuuauacauuugucccguguauugcgggcuuuuuuu

SEQ ID NO: 266 - RNA, 142 nt, Lactobacillus rossiae
acuuuugacccuauugaucugacauacagcguuaaaaucaagcaaggcuuucgagccaaguuuaaaucuuuggguucgcuauucggaccguacauaguaaaagggcgucaucgaguucaaauucgauggcgcccuuuaguuu

SEQ ID NO: 267 - RNA, 102 nt, Streptococcus thermophilus
uaacgcggucgccaaagagaguuuuagagcuggguacccagcgaguuaaauaaggcuuaguccguauccaacuugaaaagguggcaccgauucgguguuuuu

SEQ ID NO: 268 - RNA, 104 nt, Streptococcus thermophilus
aacgcggucgccaaagagauguuuuuguacucugguaccagcagcuacaaagauaaggcuucaugccgaaaucaacacccugucauuuuauggcaggguguuuu

SEQ ID NO: 269 - DNA, 34 bp, Artificial Sequence
  Synthetic oligonucleotide
aaattaacgcggtcgccaaagagatggagaattt

SEQ ID NO: 270 - DNA, 34 bp, Artificial Sequence
  Synthetic oligonucleotide
aaattcaccatctctttggcgaccgcgttaattt

SEQ ID NO: 271 - DNA, 47 bp, Artificial Sequence
  Synthetic oligonucleotide
ctcgagtaatgcttcgaaatgttactattcaggtaactaacctgcag

SEQ ID NO: 272 - DNA, 47 bp, Artificial Sequence
  Synthetic oligonucleotide
ctcgagtaatgcttcgaaatgttactattcaggtaaccaacctgcag

SEQ ID NO: 273 - DNA, 47 bp, Artificial Sequence
  Synthetic oligonucleotide
ctcgagtaatgcttcgaaatgttactattcaggtaactaaactgcag

SEQ ID NO: 274 - DNA, 47 bp, Artificial Sequence
  Synthetic oligonucleotide
ctcgagtaatgcttcgaaatgttactattcaggtaactcacctgcag

SEQ ID NO: 275 - DNA, 47 bp, Artificial Sequence
  Synthetic oligonucleotide
ctcgagtaatgcttcgaaatgttactattcaggtaactaccctgcag

SEQ ID NO: 276 - DNA, 47 bp, Artificial Sequence
  Synthetic oligonucleotide
ctcgagtaatgcttcgaaatgttactattcaggtaacctaactgcag

SEQ ID NO: 277 - DNA, 48 bp, Artificial Sequence
  Synthetic oligonucleotide
ctcgagtaatgcttcgaaatgttactattcaggtaattggccctgcag

SEQ ID NO: 278 - DNA, 47 bp, Artificial Sequence
  Synthetic oligonucleotide
ctcgagatttaaaatggatcaggccaaaattaaggactaacctgcag

SEQ ID NO: 279 - DNA, 47 bp, Artificial Sequence
  Synthetic oligonucleotide
gagctcacgacatagaggttattcattccatttcacttgaagagctc

SEQ ID NO: 280 - DNA, 47 bp, Artificial Sequence
  Synthetic oligonucleotide
gagctcacgacatagaggttattcattccatttcacctctcgagctc

SEQ ID NO: 281 - DNA, 47 bp, Artificial Sequence
  Synthetic oligonucleotide
gagctcacgacatagaggttattcattccatttcactgaccgagctc

SEQ ID NO: 282 - DNA, 47 bp, Artificial Sequence
  Synthetic oligonucleotide
gagctcacgacatagaggttattcattccatttcactgaacgagctc

SEQ ID NO: 283 - DNA, 47 bp, Artificial Sequence
  Synthetic oligonucleotide
gagctcacgacatagaggttattcattccatttcactgcccgagctc

SEQ ID NO: 284 - DNA, 47 bp, Artificial Sequence
  Synthetic oligonucleotide
gagctcatttaaaatggatcaggccaaaattaaggatgaccgagctc

SEQ ID NO: 285 - DNA, 47 bp, Artificial Sequence
  Synthetic oligonucleotide
gagctcacgacatagaggttattcattccatttcacttaaagagctc

SEQ ID NO: 286 - DNA, 47 bp, Artificial Sequence
  Synthetic oligonucleotide
gagctcatttaaaatggatcaggccaaaattaaggatgaaagagctc

SEQ ID NO: 287 - DNA, 47 bp, Artificial Sequence
  Synthetic oligonucleotide
gagctcaagaaacgatcccgagtttctggattgcttagaaagagctc

SEQ ID NO: 288 - DNA, 47 bp, Artificial Sequence
  Synthetic oligonucleotide
gagctcaagaaacgatcccgagtttctggattgcttcccccgagctc

SEQ ID NO: 289 - DNA, 47 bp, Artificial Sequence
  Synthetic oligonucleotide
gagctcaagaaacgatcccgagtttctggattgcttagaacgagctc

SEQ ID NO: 290 - DNA, 47 bp, Artificial Sequence
  Synthetic oligonucleotide
gagctcaagaaacgatcccgagtttctggattgcttccaaagagctc

SEQ ID NO: 291 - DNA, 47 bp, Artificial Sequence
  Synthetic oligonucleotide
gagctcaagaaacgatcccgagtttctggattgcttagaccgagctc

SEQ ID NO: 292 - DNA, 47 bp, Artificial Sequence
  Synthetic oligonucleotide
gagctcaagaaacgatcccgagtttctggattgcttccaacgagctc

SEQ ID NO: 293 - DNA, 47 bp, Artificial Sequence
  Synthetic oligonucleotide
gagctcaagaaacgatcccgagtttctggattgcttagcccgagctc

SEQ ID NO: 294 - DNA, 47 bp, Artificial Sequence
  Synthetic oligonucleotide
gagctcattgccaacttgtagaattgcggttcagtgagaaagagctc

SEQ ID NO: 295 - RNA, 10 nt, Artificial Sequence
  Synthetic oligonucleotide
gauaaggcuu

SEQ ID NO: 296 - DNA, 13 bp, Artificial Sequence
  Synthetic oligonucleotide
aaggctagtccgu

That which is claimed is:

1. A chimeric nucleic acid construct comprising (a) a synthetic trans-encoded CRISPR (tracr) nucleic acid construct and (b) a synthetic CRISPR nucleic acid construct,
   the synthetic tracr nucleic acid construct comprising, from 5' to 3', (i) nucleotides 4 to 93 of SEQ ID NO:63, wherein the synthetic tracr nucleic acid construct comprises an anti-zipper sequence comprising at least four nucleotides; wherein the at least four nucleotides comprises nucleotides 22 -25 of SEQ ID NO:63; a bulge sequence comprising at least three nucleotides, wherein the at least three nucleotides comprises nucleotides 30-32 of SEQ ID NO:63; an anti-stitch sequence comprising nucleotides 33-39 of SEQ ID NO:63; a nexus sequence comprising the nucleotides 40-65 of SEQ ID NO: 63, wherein said nexus sequence forms a hairpin structure comprising a double stranded double stem; and a hairpin sequence comprising a stem having at least three matched base pairs,
   wherein the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and
   the synthetic CRISPR nucleic acid construct comprising, from 3' to 5', a zipper sequence comprising at least four nucleotides, wherein the at least four nuleotides comprises the nucleotide sequence of GAUG, a stitch sequence comprising a nucleotide sequence of GACU-CUG, and a spacer sequence having a 5' end and a 3' end and comprising at least seven nucleotides at its 3' end having 100% complementarity to a target DNA, and the zipper sequence is located immediately upstream of the stitch sequence, the stitch sequence is located immediately upstream of the spacer sequence,
   wherein the stitch sequence of the synthetic CRISPR nucleic acid construct is 100% complementary to and is hybridized to the anti-stitch sequence of said synthetic tracr nucleic acid construct and the zipper sequence of the synthetic CRISPR nucleic acid construct is at least about 90% complementary to and is hybridized to the anti-zipper sequence of said synthetic tracr nucleic acid construct,
   wherein the chimeric nucleic acid construct is functional with a Cas9 nuclease having at least 90% identity to the amino acid sequence of SEQ ID NO:42.

2. The chimeric nucleic acid construct of claim 1, wherein the chimeric nucleic acid construct is capable of forming a nucleic acid-protein complex with a Cas9 nuclease having at least 90% identity to the amino acid sequence of SEQ ID NO:42.

3. The chimeric nucleic acid construct of claim 2, wherein the Cas9 nuclease is a Cas9 nuclease from a *Lactobacillus rhamnosus* (Lrh) group of Cas9 nucleases.

4. The chimeric nucleic acid construct of claim 2, wherein the Cas9 nuclease comprises a mutation in the RuvC active site motif.

5. The chimeric nucleic acid construct of claim 2, wherein the Cas9 nuclease comprises a mutation in the HNH active site motif.

6. The chimeric nucleic acid construct of claim 2, wherein the Cas9 nuclease comprises a mutation in the HNH active site motif and in the RuvC active site motif and is fused to a polypeptide of interest.

7. An expression cassette encoding the chimeric nucleic acid construct of claim 1.

8. A cell comprising the expression cassette of claim 7.

9. A target nucleic acid modification system, comprising a chimeric nucleic acid construct comprising (a) a synthetic trans-encoded CRISPR (tracr) nucleic acid construct and (b) a synthetic CRISPR nucleic acid (e.g., crRNA, crDNA) construct,
   the synthetic tracr nucleic acid construct comprising, from 5' to 3', nucleotides 4 to 110 of SEQ ID NO:63, wherein the synthetic tracr nucleic acid construct comprises an anti-zipper sequence comprising at least four nucleotides, wherein the at least four nucleotides comprises nucleotides 22-25 of SEQ ID NO:63; a bulge sequence comprising at least three nucleotides, wherein the at least three nucleotides comprises nucleotides 30-32 of SEQ ID NO:63; an anti-stitch sequence comprising nucleotides 33-39 of SEQ ID NO:63; a nexus sequence comprising nucleotides 40-65 of SEQ ID NO: 63, wherein said nexus sequence forms a hairpin structure comprising a double stranded double stem; and a hairpin sequence comprising a stem having at least three matched base pairs, wherein the anti-zipper sequence is located immediately upstream of the bulge sequence, the bulge sequence is located immediately upstream of the anti-stitch sequence, the anti-stitch sequence is located immediately upstream of the nexus sequence, and the nexus sequence is located immediately upstream of the hairpin sequence; and
   the synthetic CRISPR nucleic acid construct comprising, from 3' to 5', a zipper sequence comprising at least four nucleotides, wherein the at least four nucleotides comprises the nucleotide sequence of GAUG, a stitch sequence comprising a nucleotide sequence of GACU-CUG, and a spacer sequence having a 5' end and a 3' end and comprising at least seven nucleotides at its 3' end having 100% complementarity to a target DNA, and the zipper sequence is located immediately upstream of the stitch sequence, the stitch sequence is located immediately upstream of the spacer sequence, wherein the stitch sequence of the synthetic CRISPR nucleic acid construct is 100% complementary to and is hybridized to the anti-stitch sequence of said synthetic tracr nucleic acid construct and the zipper sequence of the synthetic CRISPR nucleic acid construct is at least about 90% complementary to and is hybridized to the anti-zipper sequence of said synthetic tracr nucleic acid construct; and (c) a Cas9 nuclease having at least 90% identity to the amino acid sequence of SEQ ID NO:42, wherein the Cas9 nuclease binds to and is capable of forming a complex with the chimeric nucleic acid, and the spacer sequence of the synthetic CRISPR nucleic acid construct hybridizes to a portion of the target nucleic acid and adjacent to a protospacer adjacent motif (PAM) on the target nucleic acid, thereby the Cas9 nuclease is guided to the target nucleic acid and modifies the target nucleic acid.

10. The system of claim 9, wherein the Cas9 nuclease having at least 90% identity to the amino acid sequence of SEQ ID NO:42 is a Cas9 nuclease from a *Lactobacillus gasseri* (Lga) group of Cas9 nucleases.

11. The system of claim 9, wherein the Cas9 nuclease comprises a mutation in the RuvC active site motif and/or a mutation in the HNH active site motif.

12. The system of claim 9, wherein the nucleic acid modification is a site-specific cleavage of a double stranded target DNA.

13. The system of claim 9, wherein the Cas9 nuclease comprises a mutation in the HNH active site motif and in the RuvC active site motif and is fused to a polypeptide of interest.

14. The system of claim 9, wherein the PAM comprises the nucleotide sequence of GAAA, CCCC, CAAA, GAAC, GACC, CAAC, or GCCC.

15. A target nucleic acid modification system, comprising a chimeric nucleic acid construct comprising (a) a synthetic trans-encoded CRISPR (tracr) nucleic acid construct comprising nucleotides 4 to 110 of SEQ ID NO:63; (b) a synthetic CRISPR nucleic acid (crRNA or crDNA) construct; and (c) a Cas9 nuclease having at least 90% identity to the amino acid sequence of SEQ ID NO:42.

16. A method for site-specific cleavage of a double stranded target DNA, comprising:

contacting the chimeric nucleic acid construct of claim 1 with the target DNA in the presence of a Cas9 nuclease, and the spacer sequence of the synthetic CRISPR nucleic acid construct hybridizes to a portion of the target DNA and adjacent to a protospacer adjacent motif (PAM) on the target DNA, thereby producing a site-specific cleavage of the target DNA in a region defined by complementary hybridization of the spacer sequence to the target DNA.

17. The method of claim 16, wherein the site-specific cleavage is a site-specific nicking of a (+) strand of the double stranded target DNA and said Cas9 nuclease comprises a mutation in a RuvC active site motif, thereby cleaving the (+) strand of the double stranded target and producing a site-specific nick in said (+) strand the double stranded target DNA, or the site-specific cleavage is a site-specific nicking of the (−) strand of the double stranded target DNA and said Cas9 nuclease comprises a point mutation in a HNH active site motif, thereby cleaving the (−) strand of the double stranded target DNA and producing a site-specific nick in said (−) strand the double stranded target DNA.

18. A method of site-specific targeting of a polypeptide of interest to a double stranded (ds) target DNA, comprising contacting the target DNA with the chimeric nucleic acid construct of claim 6, thereby targeting the polypeptide of interest fused to the Cas9 nuclease to a specific site on the target DNA, said site defined by complementary hybridization of the spacer sequence to the target DNA.

19. The method of claim 18, wherein the target DNA comprises a protospacer adjacent motif (PAM), said PAM comprising the nucleotide sequence of GAAA, CCCC, CAAA, GAAC, GACC, CAAC, or GCCC.

20. The method of claim 18, wherein the Cas9 nuclease is encoded by a nucleotide sequence that is codon optimized for an organism comprising the target DNA.

21. The method of claim 18, wherein the Cas9 nuclease comprises at least one nuclear localization sequence.

* * * * *